United States Patent 10,240,205 (METHODS FOR ASSESSING RISK OF DEVELOPING A VIRAL DISEASE USING A GENETIC TEST) - sequence listing, part 7

SEQ ID NO: 221 - DNA, 441169 bp, Homo sapiens
ttgaccacattcatttatttttataatgtcaatgtattattgatagcattaaaaatgttacagaaggcaatggacacattgtactgatgtgatattaagaaacattgctagctatggcaccaaaatttatgtgacataaggaaattataatacctaacacatattagttttctcttccctggttctaactagcaagtgccaggaggcaggctgggttagacagcgtgaccaagagtaaactttggatggtccaggataaaattataacataggtggtttgtcgttgcttgtgtttatttaatgttctctcgctttccttgtctagccaagatcccatgctatgttgacttgtcatctccagaaatgtcttcacacttggaagttcccttaaaaagcccttaaaatttacctcctctaggacttactagttccaattttttcaatattaatacacatatgaatcatctggggatcttgcccaaaagcggacttctgtaggtacagggtaaggccaaggactctgcacttcttgtaattatacttctgggtgatactgacgctgcagttccatgcaccacactttccacagtgaggcacgcaagaacatttagaactgcacattttaaacagaattgtaatatgttaggttggtaatagatgttagaagagttaggcaaacaagatttaattttgaatgcttggaaactaagaccttgaacaaatatgagaaagaaatgagaatacatttggaaaactctttttgaatctttcaaatttctttgggttatgttctttcttccttcaaaagtaaatctttcctttctcaggagttttcctcacaaatttaacaggaaataaaaacctttcaagaaagtctctttgcctctacacatctgaatattctctgtagaaaacgatgcaacctgtttttttgcaaaattccgttatttaaaaaaaaaagtctgaataactctacgttacctgaattcaattatataatctattggaaacataaagtggtcctcttttgaagaattattatatttactaatttattcagatttcttcaattgaatgaatcaatagtattctctgctcatatggtattactgaaacaactacatagaaaaaaatagcagggccgggtgcggtggctcaggcctgtaatcctagcacttctggagggtgaggcgggcggatcacttgaggttaggggttcgagaccggcctggccaacatggtaaaaccctgtctctactaaaaattacaaaaatttagctagccatggtggcgggcacctgtaatcccagctactctggaggctgatgcaggagaattgcttaaacctgggaggctgatgttgcagtgggccaagatcctgccattgcactcccacctgggtgacagagccagactccatcttaaaaaaaaaaaaaaaaaaagatgtttccctttgggagtaaatggccattgatgttacattagaaatataatagctccaaagaatgttcacctttgccactctttggagcgtgtgtgatatctccaatagaaattaaagaactggcttcacttttttgtttgtttgggtttttcttgagaaagggttttgctctgtcccccaagctggagtgcagtggaacgaacagggctcactgcagccttgacctcctaagttcaagcgatcctcctgccttaactttctgagtaactaggactacaggaatacaccacctatagtcgggttttctaaacactgcaggtatgtaagtatatactggtcaattaaaaaaattttttttccttgtagagaccaggtcttgacatgctgccctggttggtctccaattcctggcctcaagcattcctcccactttggcctcccaaagtgctaggattacaggcatgagccaccacgcctggcctgagaacttgctttattttagccaaaattattttatcacttctttcccttctcacaggttctagctcttatcttcttgtaccccttccctgccgcaatatattatcttacgcaaagcaagtaaactttcagtttcctattcccattactctatttagcaaacctaggaccttccttaggacccagcatcctcacaaggcagggtggggttgtaaatagcccccagtttttgctgtgtcataaattattttattccttgttacattagcaaaacagacatttcaatgtgaatcctccccgttgataagcttaaattaagaatataaagtacaacactgtaaaacctttgccctgatgttaaaagcctttcagaaggtttttgaaatccctatttcccacttgatctgggttcctcttcaccctgtgagacactccagctgcattgaactgccagtgttcccaatcagctgtgctctgttaaacatccacattttagaaaagcatgcttaatttttcactaaatgataattatttccccagcatttaatgtattactcattctctccacatcaaggaccttgtaaacaaattcagagcattatctgtaggttcttttaagatcatctttaaataattttcaaggtgggatgcggggagtgtcagcaaggcttctctcattaaaaaaccttaaaatctccatttgtccctgtcaaagcctgaattggaagcagggtcagcattagggtgagacaagagatgcagggttgtgcaagtgcagggttgttaaaaaggaaaaaaattgaaattgcttaagaaagtcattgcttttgaggggtaatagcaggtgtacttccctaagtacaatagcaaatctttcaaagaaaatttctatcctatttttccttgaaaataaccatattgaatacagttatagaactgtattttatttatttgtatgtgctacaatttggtgcatgcagcaaccacagttccttaaatttttggccattgttttcaggactcaaaatagctcagcattccattctataaggcccatgtttctttcccatggtacagtatgagtactttttaaagtaggtgaacataaaataaaagtttgctagttgtagtgcatatgaacaaaataaccacatgggttttatggcacatgttctaaaaagataaagatataatggagagatatctcattcaaacaggttaacattataaacagtgcaagtgagggccatagaagcaaagtaacatagtaaaattaacaaatataaaaacctaagctgaaagaggaggtatggagattttttaaatagtcctgaaagataatagagattgctcataatttgaagtagacataattcaggatttgaaataaatcatctaaaattttaaacatgtcatattgtttaaatcattctctgtcctataggaatgacggtaataacttgactatgtactttgtagtgtcctgaaaatagtatgctcagttaagtttataaattgcaaaataaccatctctttaaagtggaacagcattcatcagggaattgttcacttatgaagaggtcatccagacctggagacaagctacttttttggtgaatagaatatattgccattgctactatttatcctccttgttttcaggaatgcttcactacttattctcattatgataaactctatctcaggcttttaggtatcatttaaaacccacttgtgtggggaggttctatcactctccaaataactttgcagggcccaaggctataaatatgaatatatttatacaaacctattttgttataatagggccttgggcctactatacaaacctattttgtttaaggctataaatatgaatgtatttatataaacctgttttgttataatagagcccaaggccctattataacaaaataggtatgttataaaactattataacaaaataggtatgtcatagaactattataacaaaataggtttgtataaatatattacaggacaattatttaccattattacaggaaaattatttctcatctgtatatccaataattacacaaaatggttgtgttttgaagttggagaacaaccacattctaaaaaggcacagagcaaaaaagaaaataagctcatattttactatacgaaaaaggtaaacaaagaagtggttgaaaaatccatgttctatttaaagtcctctcattccagaattatagaatataattgattttatgtgattatcaagtataagctcttggaaattttatgatgtaaaaatagaggcaaagctgtactcattaataaaataaaacatttgattagcatatattgataaaataaaatattcatgattgtagtttattttttgttgaatttattaataatctttatatatatttatatatgtatggctttgagcaaagacaaaagaaatactctaactcatccctgatcatacagttgttgtaagaatcagctattctattatctttccagcagcagaaagaccaatgaataatacatttctttctgtacagattaaaactccatacatacgggcttcactatgtacagagaaaagaggtcacttttcaactagcaatggacctttatattacaggaatgtgagtcatttttttttcttaatctaagtatatatacattcatacatatatgtatataatttaccctgtacctttttattagtttaatatataaaccttagtttttttgtccattctattacaaagtgaataaaaattgtatggttgcactgaaagaccatgcatttcaattttgcttatgtttcccaatagtgctcaaaataaaaaaccaaaaatttatatatataaaaatatttcactaccaaatccattaatcctatcaaatgtaaacctttaataatttaaaggaccaatacgtaatcttaataaattgaagttaattctcatattttaataaaataaaggagttttgtactgatatgtaaatggtcttgcagctttcccataggttctaggtagactgaacaatccctttcttacaacagtattcctgacatgccatcatatgtcaccagcatattgatgattacattacatcgactagcagttaattacttccacaccagttgggatttgtttgaaattaaacataacaactcattttggtattataggtattatatccacaaaaggcataacaggcagcaaggatccactttagagtttctgcttttgtttttgttttctgtcctcaagtctatctgcaggccctgtcccacataatgtgtgatctctgtatgttcttaaatgtattgccagtgccagagatactgaagacctccactttaagtcatgctcttaacttgggttatttaccgcagccagttgttaggaatctttcaattgtgttccagtcatactccacatgtgtgggatgcattaggcacaaatgattactaagggagttctttgagaagaagcaggtgctcacagatcatgtaaagagttaagaaaacagacagacaatgctcatagacgttcaactttacccctgctttctgtcaccatgtctgtactattttcaacacattaaaaatgacaaacctcctatctaagggctacgttagtcaccacatgccttaaagtttactaaccatttagttacaatatacatagagcaaaatgtgtgttcccaaacagacgtgatgctgtattgaatttatttctttaaattaataccatagtaaattaccagctacagtgaagacacagacaacacttaactccaaatcaagctgtggtttacaaataattatttaaataataatagcaataatattaaataaaagtgaaaacctcacttctagacttaagtcagagatccaagtcagccttataggaattataagataggcaattaatgaattgttatgcttttctagaaacgagaaatactgtaagcctttctctacaatgactgatttgaacctatttttttttccccagaagcatgcagggactattttcagatgcttgattatggcaagaagaaagaaaagtaacgatttttggtgtaatacaagcaatttgtagattcgagcatacaattttgcataaaacattgcaggttaaaataatattgtaggtttcaagccattgcattacaattgaataattctcacaatcaggttttgtaaaatttaaaactctaagttttgaagtgaagcaataaaactaaattcttaaacaatgacttttaccttcatacaacacagaatagctatttttatttgggttgaaaaagttatttacaactaacattgatcgagtcttggtaaaagtccgataacacatgaagacaaatattaattttccctcagctttctgaaagatcaatgaacatgtttgaggttagtgatattcttaacaaacagtggcaatgctagtctcctacggtggccaagcaagtagtgcattctttaacctaatttgaaattgaaagcaccgaaatacaatttagatctataaaatgggatttgttatttaattctccaccattaatgattaacaatttagatgcagagacacagctaatgaaagaaagttttgattggtgctatttactagttcatttgagttgcctttttaaaatcagttttgtttccattgaatccaagaactcttcataaaatagagaaatatacatatcaaaggacttaagtaaaagtaggttagaaataaataatcttacaacgacattttaaatcctttaatgatttaaagaaaggaagacatataacactgaatgctaaacaggtcttttgaccctctcttgggaatttagatatatattttatagtatatgtatatatatttttacatttcacgtgtaggccacagctgtctaaaatatctcttcatagtaggctagagggatctatcaggagatagaataaaataagatctgagtatagtctcagtttatgagagtatttctttctgctttgacaatcagcagggatcataaatttgaagcaaatcgtggcttttctgcgtctgggtctgtgtttaagactgaggaagattctcttggaagagcagctgctggtggagggggtgctggagggactcctcggttcggggggatggctcccgacgacatctgtcggaagagggtgacgcgctgcgggacagtgctcctgccccctgcctgaaggcccgttccggggaccgccgtcacgggttgagggatggaggccagggactcgcccacagtgggatgaggtctggaaatcagagtggacacctcatggggcagcgagggctgcgaggcggagagtggcctgacttcccgggtcaggttggtgttgtgaagcgcctgcgtgctcttgtgcacttcatttttcggcgtggagctgccaggtgtctgtggctgcggggacggctgctgtggctgagtctgcggcggctgggactgctgtacctgctgctgcggctgctgttgcatgagtgacagctgggaggcggtgggggaggcatagtggaaagttcgagcggccagagggctctgtacaggagggctgcagaccgcggtggtgtaggagcagggtgacaggatggctgatggctggggggtctgtgtgctgggactgggggagtgcaggttgctgtgagacaggctggtcgctgtgtacaccggtggagattgtgtcctcatgcgggaggtcggggtcgtagtagacgatgtggaattcagggttgtcatttgaggataattgatgggagcgattgcctgcaccatctccctgtcatgtttcacaatctgcttgaggatttcgttctcctgattgttgaaaacaccagtgttcagatccttctggaacttttgcagaagaattgaatttttctttcctgtcagcaaaagaaagataggcacttagaaagcctaccaatgactgatgacaacgccaagtgagagtggctcctgcaaacagaagtatagctgtgcttcacaggagaggcttaaaaagccagtcactcacctttacacaccaaataccaatgtggctcctacctttcacacttcctgtatttctctgggaactcttaccttctactcaagttgaacggcctgtaatatggcaaagagccactttacagaagaaatggagatatttaacatgagggccaccttgaagaatgggggaagaaagggcttttggaataggatgggcttggaatcaacatttgattttaaagttactttttcaagaaaggaccatggagacataagcgagaacatttgaacacgtactatgtgataagcactctacaaaagaccttaggtagatgattttatgtaacccgcgaccctgtcagataggtgtgttcataatctcattttacctgaaaggagatcaggacatgagaagactaagaacagtgcccaggaaaacaaaaaaaaaacatggttggcaggtaacagggctgagaaagaccatatacacaaaaaagtgattgcacatccttgctatggaaaatgaaccaactgcccctgtctcatctgtgtgcttgctagaaactcagcctcctgggcctgaccccacttgctgaatcagatgttgcattttactaagatccccaggtgattcccaaatgcaaatctgaggaggactgtatcaggttttgcttttgacccagtgtcttacaccagtcattctcagtcctagttggatatttttcttatctctggagctttaaaaaatactaacatccacttgttccctaccaattaaatctaaataatcatacatgggctctgaatttcagtagtttaaaagcaaatttccccaggaaattctttttttaaaatttattatttatttattttattttatttatttatttttttgagacggagtctcgctctgatgcccaggctggagttgcagtggcaccatcccagctcactgcaagctctgcctcccgggttcatgccattctcctgccttagcctcctgagtagctgggactacaggtgcccgccaccgtgcccggttaattttttgtatttttagtagagatggggtttcaccatgttagccaggatggtctccatctcatgaccttgtgatccacccgcctcggcctcccaaagtgctgggattacaggcgtgagccaccacgcccagcttccccagggaattcttaaatgcagccaagactgagactgactttatgatctttcctcttctgaatggttgttgtgaggaccaagggcatagtgcattgcaggctctcagctccctctaagacctcaataaattttaccttttcctgccatcatcttctgagtggtttgcaatacagcttttcctgccatcatcttctgagtggtttgcaatactagacagtctctggcataataattattagaatgaatagtggattggtgaaagaaggggaaagtagtgacttttctatggcatcattgatacactaatctccaagtgaatatggtaactgaaaagtgaatcaatttgcgatattgctaaataaactaacacattaaaggtaacaaaatatatttttgaagataaatatgtattgtaatttcattgactgctaggaatgcaatcattttaaatgactgccaaaatagttacctctccctacttacagactgtcctaatttcccaaagaacaaaaactcctacattagtaataaatataaatgcttatttagcatatttgcttaactaactgcagcatacatctatatgcaatggccacaaaaccgagaagcataatgtttctttctgattatgtgaacagtcaaaatatcttaatctaagtatctttaaccttgggaaaaataatgtaacttttaatacactcttactatgttataaagatcaaaaattcaattgcttagtgcctattagaaattgcattgcctgtattgattacgaaccatttcatgtaaatattgttataaaaattaactgcaggctgggcgcggtggctcatgcctgtaattccagcactgtgggaggctgagatgggtggatcatgaggttaggaggtcaagaccgtcctggccaacatggtgaaaccccgtctctactaaaaatacaaaatattagcagggcgtggcagtgcacacctgcagtcccagctactcaggaggctgaggcaggagaattgcttgaacctgggaggcggaggctgcagtgagccgagatcacaccactgcactccagcctgggcaacagagcaagattctgtcttaaaaaaaaaaaaaaattaactgcaataagttagatgaaagtgaagctgtatcagattaacagaaattatctagtgaaatatcctgattttaatgttttctctaaggatgtctagctggtttaggaagaaactcattgcttagaaattagtctctgtctctaacataaacactcacacactacaaagagggaagttattttccaattaagtaaggatgccttcaggagtgcctacttcttttgtgggtattgtctccctgaatgagtaggtcttgttaaatctctaagatttcaatatgaatttctaatacgtttgttatatctaatgatgatgtccaaatactgcctttacttctaatctattttcagatctctatgcagtctgctgtcctactaatatagagagaaaggaagatgtgaatgtgaagtgcagaaaaaaagccaacataacaatttatcaatctgaagtccttacctttaataagaatgaagcagttgaggtacctccttgtttatcacaagtgatcccagccccatcttttttgagttcatttattccttcctcccttcctacctctcttcaacaaatattcattgtatactaggtactgtgaatgtaatggtgaattaaacatgagctctacattgacaaatttagcatctctagagccagtaataaaagcagtgctgtgatgggggagcttcagaggctataggagaatgcatccaaggaactgggcttagtagggagtgggaggtcagagaaggtttctagagggaggtgatatctaaacagagagaggaaggttgagcagagtcgagctgaccaaaaaaaagtagagaaggggagggtggcaaagagggtttaggtgtggaaaatgaatgcatactaccttacaacataatgttccaggatatctaggaatgttaacagcaagccaatccaagctaactttactatggcaattatgcaaatcttcaaactagcataactaataaggcctaatggttgtatatatatatttttttatttggtagcagaaaagactttaaaatatgttgatgtttgcgaggtaaagcatctatgtagggcattactatcaaggctttttttttctgcttgagtctatattacaaacattttattatgtctctgctgagattaatttaaatgtgcaaattttcaattcctaatataaagataaaatgtaaagttgatccaaaaatacaaaaaaagtgataaaacttagtttgtaatatagactcatatatcatatttttagttctatttcaatgctatctagaatttttatcattgctttttacctgaagattcaaattgttttggcatcagtcgggaaatcagtttgtttagctagcaaaaatagacattaataaataaacccagaatacttagaagagatagatagggacccagatctctcaagaaatacggctacagctaattgctatttctacacaaattaacaagcaagctataaactggcatgtgggattttttttttttttttttctctgagacaaggtttcactctctctcccagacgggagtgcagtggtaccatcttggttcagggcaacctccacctcccaggctcaagagattctcctgcctcagccttctgagtggctgggattacaggtgcacgccaccacacccggctaatttttgtatttttagtagagacagggtttcaccatgttggccaggctggtctcgaactcctgacctcaaatgatccacctgccttggcctcccaaagtgatgggattacaggcatgagtcaccactccccactgcatttgggacttataattgcaaacctgtattatgccaggagattaaattttatataaagaaggtagaaaactagagtacctattcgatctagtcggtcaatggcaactgtctcaaaggctctcctcatcattggatattcctccaggacctcgttgaaattgtccacggaaagtgagtaaagacgacaatatgtatcagctcgaacactggcagtacgacgtcctttggtcagcaggcaaatctctataaaaacaaacaacaaagaagaatgacttgtttgatcattttcttttaaaagccattaaggcttcccacaacttaaaacaagtctcatggtgtgaaaaaacaattattagcagcattttctattatatcagcaaattccttctgacaaaaatatccgactgccaatactcaatcttaaaataatgtttttttgttttgttttgttttaaaaaaaaaaaaaacagttgagaaggccaggcgcagtggctcacgcctgtaatcccagcactttgggaggccgaggtgggtgaatcacgaggtcaagagatcgagaccatcctggctaacatggtgaaaccccgtctctactaaaaatacaaaaattagctgggcttggtggcaggcgcctgtagtcccagctactcgggaggctgaggcaggagaatcacttgaacctgggaggcagaggttgcagtgagccgagattgtgccactgcactccagcctggcgacagagtgagactccgtctcaaaaaagacaacaacaacaacaaaaaaacatggttgagacttttggtttaaatgcaaggctgaaacacagtataccttatccttcccactccaatcctctgaaataagaaataaagaaaaaaaacaaaaacaaaagagatgcagaaaatggaataaaatgtccacaaaggagttgaaaaaagaaaggggtgatgattagaaagacgattttatgaattctggaaggcagaaagcagatggtataatctaggcagaagccaaaatgagtccaaacattggcttagaaagtcctatgatcaaacaaagctagaccagaggtttagatataggcatgtctaatgtagtttgtatattcccaatgagatcagtatgaagaaagtgatattccacatgtacagagggactctctatttaaatgacttttaagggtaattccttactgaaatttagatttccaaaatatggtaaacaaacatttgcaaatttggatttcattattggccagctgaagctatatagctattaagagataattttccattttgttttccaaaaattatgatttgaactactgtaggctttgattatttttaatttggaaataatttaaacatttagcttcaaaataacaaatttgaaaagagaaatgatagaagtatttctaaaatttagtcacctaacaaaaggaaataaatataatattaaatgtctaaattcacactcgagctaatttaaagaagttctatttatgttgacaaacactgtgaataaatcacgctgtagacacatgtacgttcatttgaatacaatctggtaagaacaatgtcacatatatgcaaactctgagaatactagagaaggacacgtgaaccagtctgggaagatagagaggattttaggaaatgtcacctaaaccatcaattatgctgttgttcttgtcaagattgaaaagtaatgttgtaaacctgctaaataatattgtggggtctgtgtgtttgtctgaatgtttttgtgcctgaatatgtgtgtgtgtctgtgtaggaaaataaatctattttggtcaattttaaagcaaattaccataccatggaatttacctgctactgtaatataaacaaggtaattaaaagaagcattttgaatactactccaaaattaaattcctgtgtcactaaagtactaatgccatataattataatttatgattgccacattatggcaaacaaagctaagtgttggtttcaaatcttgtgtggaatgctaaatgaaagaagacagacatgagaagccacatactgtgtgattccatttatgtaaaatattcagaaaatacaaatctgcagagacagataacagattagtggttgcctgaggcaaaagatggaaaagggaattaacagtaagtgggcacaggaatcttatttgggtgatgaaaatgttctaaaacctgatttgtggtgatggtttcatcacttggtaaatttacttaaagatatttgaattctacactttaatgaattatatgtgtaaaatacgttgcattaaagctatacaaagtgaaaagaaaattagttttgtttttattttttatctttatacttattatattttcatttgaatttattttttctgaactctttctctttactctggaaacattgttttgtctctttttctaggtctttctcttgtgtgttgaatgttttcttttggtaatctattgatgtccaatcacatttaaagataaaaaactctggtaatgttgcagaatttgttaatttaaagtttttcattagggtaaataggcggggagcttgtcctcatatttctctaaataccagaatgaggagggctttactctaggccactgacatctctcttaactgtcctagttctccctctcattcaattgctttatgaacgaaccactgacatttccccccactatcctcaggtacatggttggctacagactattccgcaacatggagggagggatgtctcatacctaccatcagcataagtcacccgctttctgttctgtcttctgtggtcctgttgtctcttaactaagagcctgtttagtattcttccaggatacctgctgtctccttggctcccgttctttgtacgtatattccatgttccctctactttcccttcaaggttcatcagtaaccaccagcatacatttaaatgcaggctacagaatacctgaatagcactggtttatccaatacattaatgtcattatattacaaaacaaaatttgggagtaggcaaggccagcatttgttcagcacttcaatgatgccaaggcactgtgcccataatacttttgttttccttggccttcttctcatgatcacaagttgatagcaacaactacacacattcatatactcacacaacagcatccaaagtttggggagacagcaaaagactttcttcctatatttctttctttttattgtgaaggcaaaagttgtactacaggtccctaacttactttctctggcattttattatcagaactgcatcatgtggccagccttagctgcaagaaaggatttaaaacggaatatttggtaaatcggaataaggtaactactgttagtgattgagttaggtaaatactggtttaatccctgaagtagtatatgatgccagccatacaagattttattaacaagaaagggccatggttgctggctatggaaccaatgttatctggcacttcactcatatcaaaagtattttctgtcttctagaaacatgtccctttgtctcgtctcctggttgctcccaaatacaaattcatgcatcaggttactttgtggttgagtttatattttattcttttactattattaattgggtctctgtagagggatgagataaaggcatgtcctgggaatcatcttaaataagaaatgtatttgtcttatgcttagaaattacttggaattatttttacaaagagcatgtgtttatatattatttttaatttttaaaaacaagtttaaaaattagaaataagaatatagctattctcagtatgcacagtcattttacagatatgttaaaaacagatttactggagcatagatataagtttagtcaaattttttctaaaccattatttacaaatgattttctggcctctgtcatctgatgatctcatataatgaatatataacatatgtagcatatgttacatagtataggtacacattactaagtaatcatggcttgaatcagttaaatattaccattggtaagaaaatcttcaaggaggatgcttttaaaatactgtttaaagcctacatgaagaaatgtgtacgtgtgttatgagctcttaacccaaaggttttctatgttgccatctcagtaaaacttagatgttactgttcagcaaatcttacctcttcattacattttgtttaaaaagataatgtacttattttaccttttgtagtttgtgggatcaacactgatattctaatttggtctttcttgccagttaatgaggtagagtgctgtttggggcattgtctacagcagtaatgtctggtttcctgctgattcaggtacacacacacacacacacacacacacacacacacacacacacagacacagttgcttgggctattttagggattctttttttggtatagtattggcctggggatttagagtcctgtgttagtctcagtcaacttgctcttgtttgtgagaattagacacccatttatattctgtggagtttatttatcagtgaaaagtaaaactcaattatgtctctagagttttattgtccttaactctgtaactaacttagacttcattcaacattttatctgtaaagtctcattaatctttatatctccagtgcctacatgacagatagtaggggcttaatgttagctgacttgaataattgaatcaaatagcaacatgcttaatgaaataaattatttaatcacctacaaaaattccctttgtatttaatgtgacatattcccctacggagcaactaagggctaaatatagacttgcacaacaaagtcccttcaaaagttatataaaggactttgttcattaccaactcaaaactcatcagccattaccttgctgcatgtcctcaataatttcttagtgagaaaaagaacaactgaaggttattcatgagaggagaaatagtcattaagaagtatgaaaaacacttaaaataatctcttcttttaaagcctccatactctgtttctagtatgaataacagaattaagaaatggcacacccttagcaacgaaaaaagagtaaactttctgatcaaagaggcttagatttcatgaattgaatgtccagattaattttctcttgatacaatattaagctattttgaaaatctacttattgagtaaacacagccctttgttaggtgttacagagttttggtgtatttgccatatctgtgtgtatatgtgtctttggcggggatggggggtgtttaaataaaggatatatatagaaaaaaattagtcatctgtagctcatactatcctttaggtaccttagaaattatgtatgtattagtttatcactatttcattttattttattctactgaatttctgtttcctaaataatggctttatcaacctagctggtttaagacattttaaagacagaaaccatatagttaccttataatatcccttatagtgcctgctacattgagtttccagcccaggcaaaatgatttaaaaatgcttatgcataccccaattacagtgaataaacataaaacccacactaagttatcttcttaagttttggataatattggttcacctgttaggcatcttcccttggtcatagaacttgccaaatgttttacgtactttctttgaggaacataacatatctctgaggttttgtgcaatgtttataataaagaaaactatctggaagatttggtcatttttttttcaatgtagacatgcctttactcatcaggaagaaaattaacctgcttatagatatgcatgttgatttcataaagcaaataaagttaaatacaaaataaaataaaattggactcccaaagaacagattcagtgcagtttacagatgcaagctttttaaagattgtcttggcatactttctagaatctgtctgttccagcctttctgcttttttcttgtttgtatactctctgagagctcaactaagaacttcccagtggtgtaataactgttttaagaatcttagtgcaaatttacttgggtaataggtcccttcatctggatgcgtatttacatattataataaattgtaaaagtaatggggacttagcgtattaattttaattcggtagaattttcctggttttctttatagggcgtttatgaatggctaagtagttatttcacctagttaagatgaaaactattggtaatgcatcctgtataggaacatagacaactctgtttccaatttcagtgtcagaaagagtgtggcctgggagactagatttggcctagcacattatttgtatacctttaataatccttaaggtatgagatatatcaacttctcaatgctatttttgctggcattagttaaccctgattataaacatttaagtccacctgacattactgtcacctacataaacagtcatttttataaggtagggcaaatggcttcaaacgttttgcaactcagaaatattttcctgacctctaaaactgaacttgacattgctgtgacacagagctaatcaggaactcatgacagaaatttctaaagtaatgtgcttaacctgagcttctagaattttgggcaaaactgtacttagcttctcatagtaacctaaacaaaagctgcttccttctttagtaactgataccatgaaataaaagtaattctctgctgtgcatcaaaatactaatttcctataaattatttagatttctaattcactgtgttataataacatgtaacagaaaatatcacttttttgctttctttttgtctttgtagactttctgtatttatattagtgaactagtaaaacactgcctctgtatggcacaggaaatgataacatctggcttaaatcattttgcgtatcatgtttggctggtagaagtactctgggtatcaaatagatttgaatagaaatcgaaagaagtttagactaggaaagaacattaaataggtgcaaattttttagtatttgattgatttcttagtacagtactttaatgcatttcacattttgtacaatcttctgaaaaagagattgaatacaacaaatttctaaatatagatataaagaaggtattattcatgtatagattacatattataatattctaataaccagaatacccaatttttcattttactaagggtataactagtcatttcaactcacatagatacattcctaattgcacaattatttgtgtcctcttctactactcatgccctgttatttatggttatttagatcaaataaagttattgttttatcaaacaaatcttagctccaagttcaatcaaatcatctctcttaaaacatataaattagagtgatcacgtgggcctctgaatgttgacctagtagcaactcttcagacaagctatgtgttagcaaagttattcattgacaaagctgttatgtggttaactaaaacagtgcctgtaaaagagtgcctataaaacagtgcctataaagagtgccaccacaagcctggcacattgtgggtactcgtaaaacattaatttccttcctttttccccatttccttgtattctaatttttccttatgattttgatggtacctgctagaagcaaataaaagtaatgcttcacacatcaagtagctctccaaatttgtgatatataactatcatctttcaccatctcataaacaatttgttcataaactaatcatacaaattccttagactgtgtcttgaggaagatggtttcacatccactaatactctttcttaattgtcccagggaaaatttatctttgtgcttcctctgtatcttgatcatcttgcatcttagttcctacattattggacttacttgtttataatctttatactaaactataaggtctttaaaggaagtgcaatgattgcttttgcaatgtcatcacttaccaaacattgtcatatattatttgtttcaagaaatatggaatgttgggaggccgaggggggcagatcacttgaggtcaggagtttaagaccagcctggccaacatggtgaaaccctgtctctactaaaaatacaaaaaattagtgggtatgttggcaggcgcctgaaactccagctacttgggaggctgaggcaggagaatcatttgaaaccaagatatggaggttgcagtgagctgagatcgtgccactgcactacagcctcggtgatggagtgagactctgtctcagaaaaaaaaaaaaaaggaaataagtgaatcaatcaataactgaaaatggcttacatcagattaaaaatattcttcataaaacaaggtgctcacatttgaatacaatataccaaataggcaaatctttttgtgaagctttggctccaattgacagaagttataatacaaagctctcatctggttcctactaatcataaacatgtttgtaacatgattgtttgattttgttgtatatgtgaatttttgaaattaaggtttacactttctactccttaacttctctccctttcctcttctttatctgtgtctttcatttccattgtaactccttcagcttgcataaaatcagctttacataatactgttggtaaacttatatagaatatatatttgtactacttgtctttggcaagttaaaatacctaatggatattactgatattacagatatgttacgtaggtaggaaacaatctcaggtagccgcgtgttagcccatgtgacataaacagattaaaggggttctgttttgtgattgtaacaaaaataacataaaaatatcaaagctaagaagggtaaaaccacaatttttctgcttctatctgtctttaaaaattcaccagaccattccaaattgtccctttcaatctttaaatctagcagcactcaagtcgtcaaaagttaatcaaacaccttgaattataaatgcctttaaaatgcagccagcttttaaaaattcatcaaatgatttttggctcttaggtacctccaatgtgttttttgaagtaatatcctgacagctctgttttcctatgtggcttaatatgcttctaaaaaatgaaaaaaacacgtggcagaaacaatagtctccataggcaatatattcaccagatatttatgaggcaagtctactacagcctaaaaggttatttgtctccaaaatatttcccttgatgctctctctttctcacacacacacacaccacatgcacacatgataaaatcaacatttaaacatgcatttcctctatttgtttaatgcaaaaattcattcattcattcagaatggattcattagtgcagtgtcacactttaatatgtatgggaatcacctgggttgtcttactgcaaagcaggttaggatttagtaagtctggagtgggatgaaagaatctgcaattctagcaagggataagtattaccactgataagcttcttttgggtaatgagttcatatagctgtcagatttataatttaaaaagagttcctcatttagaagaagttggaaaaagtaaacaaaaggaatggaaattaaagataacatgaattcaagttaaccaccattttccctgcaacctgtaccttaggcaattgtggagaatacaaaataagtatattttgtatccttatcctgactgaaagagtcgagaattataaattcaagcataatatgaaaaaagatttgagcataattccaaggctaaataacctactagagactttatgtaaattcaaataatatatcattcatcatagagtaattctgtacatcattggtgacatgaagggtcttggttagacttcaaaaaagtgtagaaactacattacacaaactatggggatgaagaggacaagagaaaaggaacaggaggggagaggagacattagaatgaaatagtatcatgatacaggttcaaagaaaggtttggaagctaatttttatgaaattttggaagagcagcttgacaggatcataagtatttgattaggcatagagaatatttctccatgggtaagaaagttagtcctggtctacactattattttagggctcttcaggaaaaacttcgtgtgcaaaatattattttaagaaattaacttacatggaatagagtggagagttctagctctctacatatcttgccatttatgggaaagatagttagcctctctttctccaacaggtaaatttgttctctcaaatcttttgcttcataatacaggcatatttatctatagtcagtttgccaaatgagctggaagggaagtttttagtaaagaattgtaaagaagttttgataataattttggggaattgattgatctaaagctgtagcactgacaacagaagtagtctctctaaataatcactgtaaaatgaaacttcaacagagcttgaaaggggatgaggcatccatgattttgaacctaaacataaacaaaacaaaacaaaaaaacaatgctaggctgtgtctgtcctaggagtgaatataagataaaagattgttttgggaacaaataaagcaaaacttttgcataaaaaaactaatttcatgaaactctttctcacattaaaccagttattcttttattaaaaaatgaaagcagtatttgtgtgtgtgtgttttgtacaaattggaaagcttttctcatgtgactttaaaaatctctgataactggttcaaccaggattgatgcttactccaaagatggtcatctataactcaggtagcagcccatacaacgatctggctggagaactctttcgatggggatgcttcaatcagactgtgactaatagaattaatcatacccattgttggggagatttaaagtaaagaatgaatagctagaataatcagagtgcatgagttgtgagaatgataaatccccaaagtggtgttgggccactggcatcactgtggtttcctgatggacaatctcacttgccataaagtctgcctctaatactcctgagataatttcccttgcttcttttcttcctgtgatcccttacagtgcttcttttcttcctgtgatcccttacaatgcactctatcatcagttaatctgatctttactttgtgtcatccccctgagtgcctgactcatacacatctctactcgtgacctctttcaggtccagaagttcataccagtccattttgttaagagcctctaccttttcttttatttccttcactcgatagattacaatgagttcttcaagttcagtatgtgagtagccacagagaggtcttgaggtaagtagaaaactaatatcctacctataaagttttcattttctacttttcagtaatttgaagtattcatagaggacgactgggaatcaatctttgtgcaagataacagaaaaaatttattaggcaaataaagaaatcctattaccactgcccaatcaagaaaacattcacacttacaaatcaatcctaacagaggtaaatatctgttgatttttttcccactccaagaaacataattctatatgaccactaatgagcaaattgaaagtaataattacaatcataaaaatgccactgaggttttgagtttaaaaagtttgtatgtaagcttaagtatgggttgataagaaatactaatccacatgaataattagttactttagttagtagtatgtgttaattgatagaggtagaatgcatatacattaaagcaatgataatgataagaaaatatattttatagaatgttttttccttatatatcttattcagaatgagttaaatttggaaaagaggcttgttttgaacagacgggttagatcaggagtcctataaccaaatccaaccattggcttattgaactgctttttttaaattaagaaatggatttacatttttaaaggtttgttaaaataaaagcaaaaatgaaagatggatatacaatcatatatggcttacaaagcctaaatattaactatctgaacttttacagaaaaacatttgcctactccttggttacatacatttttttccttacaaatagatgtcctttattgaatcttaacttaggcaaataaaatctggaaagaacagaaatcagcagactaaagatgtataagccactatttagcttgtgactttaagcaaagtgaagtgaggaattaggtcaaacagtccaacaggttatccaaactacatattatcttttatatttaaaaaagaaattctctctgactcatttggtcaacatgataaaaaggacaccaggaaatcctcccaccaaggggtctgcctttcatccaggagaaaagacacacactcattgtttcaaagcttaactgaggtgtgatacatcctgttgaaaccgtgttcaaagaagcctcatataaccagaaactcaataaaccagtattttatttccatatttgagaaggataaggatgagaaatgactttccaaaaagataaaagttacaaaaaagcagatttttcctatattttgttaatgttttattgcagaaaattgtaaacacataaaagtaacaatatactatattactagaatactagtagaagagtataaatctaacgaattagtagaatagtgtaacaaaataccataataaaatctcatatgttccttgctcagattaaacaatcatcaactgatagcttgtttcactggtacctcatacatttccacctaattattttgagaaaaattgcagacatattatttcaaagataaaatttcagtatgcatcactaaaatataaatattcttaaaataaaaatgtccataatatcaccataacacccccaaaattaatagtaatttcttaaaattatcaaatacttagctggtattaacattttttaagcaggcacatattttgtaaagaagttatttgcaggtcatgtcccaactccctcactttcctgaggagtctaaacaaaaacatcctctagaactataacacttaaaataattaaaaataagctttgaaacatgaaagatatataatttattataataccatatcaggacaagaaaattctactcatgtatttcaagaaaggatactagccaatttttacagcatcaactaaaaacaaaaaagaattttgctgttgttgagcactagcaaaatataactaaaatactctagtcctagaatattgatttatcaagctgtatatttacttactattttgcatcatcatcactatcatagcagaaactcctagacagaaagatgaaagacaactggaatttcggaggtcaagtgagaatgaaggaagacttgaaagaatctcagaagaaaaacaaaataaatgcaaagagaaatcatctgaatgctatttgactaatattaacttctccacttgtgttccaatatataaaactgaatgagactttctagactagggtttctcaacctcagccctactgacattttgggccagataattttttggtgtctggagttgtcctgtgcattgtaaaatgtttagcttcatctccctggcctcaatctactggaagccaatagcaaactcctcacactgaaagtaccacaataaggactgacaggagtgctcatgaggacatatttttggcctcctatcttcataaactctgctctaataatccaaggtgccaaacatgctcatgctttgtgtctttgtacaacttttggatcatatttacaacagaagcttaaaattatgttttagatatcaaagcatctataaataaactttttgggacatttgctttaattatgcaatcttttttggatactcttcttggaacgttgtaaagcaaatgctaatcactttgttcatgagagatagctatttaaacacattaaaaatgcttttcaaaaattccgtctatttttcttttccattcaagtgtcaggtaactccagttggtttaccagtttaattaaccaggataaaatagatttctgctaaagaatctgtggcatttagattcagaggcaaaaaaaaaaaatacagaaaaataaaatttacattactgttaataaatagtatcatgtgcaaattgtttatgacagacaaagtttgattcggttggaggtttttgttagtatgttgatatggtttggctctgtgtccccacccaaatctcatgtagaaatgtaatcctcagtgttgaagaggggcctggtgggaggtaattggatcatgggggtggatttcccccttgctgttgtcatggtaatgagtgagtactcaagacttctgcttgtttaaacgtgtgtattacttcccccttctctctctctctctcctgctccaccatgtatagtatgtgcctatttcctcttcacctttcactatgttgtaagttttctgaggcctccccagccatgcttcctgtatagccatcagaactttgaatcaattaaatttcttttcttcataaattacccagtctcaggaagtttcttatagcaatgcaagaacagactaatacatatgtgcagacaaaaaagtatttgagagcatgcagacaaaaaatatacaagagctcttctcttctttttttttttttttttttttttttttgagacggagtctcactctgttgccgggctggagtgcagtggcatgatctcggctcactgtaacctccgcttcctgggttcaagcaattatcctgcctcagcctcctgagcagctgggactacaggtgcccgccaccacgcccgggggctaatttttttttgtattttagtagagatggggtttcaccatatttgccaggatggtcttgatctcctgacctcatgatctgcctgcctcagcctcccagtgttgggattacaggtgtgagccactgagccctgccaagagctcttctttttggctagctatagtatatgtttagtggaatgttaaaagattcacatacaaagatattctttcatattgagccacacgtttaaattttattgacttttacactggtacaaaagcacatagattatttattttggtagagaaaactgaataaaatatgcccaatactgtcacataggactatcaaatatcattaataaattttgcaatatgttttccaccatataatgatatgtatataagtttaatggaaattccttcaatatttctttagaacaccacttagtaaagcattgaaaactactttgtagttacattgacaatattgtttcatttgtgctccatgtgtaaaagaaatgggctttaaaaattgttttcccaatatcaatgtaaaacatgttgttgttactggctttcttatatgttatcttgagtagaatgttgccacacaatatcttgaaaatacattgaaaagtattaattcaaattatgtgtagtgagtggatttagggtaaagaaagtttgggtcataaaaacaatcattctgtaatttgctgtctagctagatatagtacaagagttttcctagccaaggtaaagacaattcttccccaaacttgaattagtatctcatgaccattcacatttggatgctactgtcagtggaataaatttcaaattccttaatctggctttcaaaaccatccataatctggtccgatttcatgtttccaactagtactgtctctaattacaatctcaaatgctccatttcaattcagcaagcatctacttagttccagctacgtgcttcattctgtgttatgggaaatataccccgtaggactaactagtaattctttcaatcagctccagtaatgctcttggtcattcttttcttcagtgtgtagtgtgtatttctctttacagaaaccctattcttaaggtcctctacatacctaaatatcatcatttattgatttaaataaaatattagttgagttgacatgtttgtctattttttaatctcttcacttaatgtgtaatcttttaaatcatcagtaataaaaataaaattaagctttgtaaaggtaattacaaacttgtactgcatcctccatatctgaactgggtctaagaaagttcctactttccccaaatgaatgtgactttatgatgaacattgccatggatgaagatgaaaatatactttgatagcatgttcgaaattattaaagagaatagtataaaatgcacaagtattttctatctttaatctttattatacttgggaaaccaacctatgaaatactattcttgatataggaacggccaaatatttcatgacaaagatgccaaaagcaattacaacaaaagcaaaaattgacaaatgggatctaattaaacttaggagtttctgcacagcaaaataaactatcaacagagtaaacagacaacctacagaatgggagaaaatttttgcaaactatgtagctgataagtctaatatccagcacctataaggaacttaaacaaatttacaagagaaaaacaaacaacaccattaaaatgtgggcaaaggacatgaacagacacttttccaaagaagacatacatgcggccaacaatcatatgaaaaaagctcaatatcattgatcattagagaaatacaaatcaaaaccataatgagataccatctcacactagtcagaatgtctaccattaaaaagtaaaaaaataacagatgcaggtgaggttgcagagaaaaggaaacacttatacactgttggttggagtgtaaattagttcaaccattgtggaaagcagtacagtgattcctcaaagagctaaaaacagaactaccattggaaccagctatcccattaccgcatatacaccaagaggaatataaatcattctactataaagacacatgcatgcgtatgttgattgcagcactatgcacaatagcaaaaatgtggagtcaacttaaatgcctatcaatgacagattggataaagaaaatgcagtatatagacatcatagaatactatgcagccacagaaaagaatgagatcctgtcttttgtgggaacacagatggagctggaggccatttcccttagcaaactaatgcaggaactgaaaaccaaatacggcatgttatcacttataaatggaagctaaatgatgagaactcatgaacacaaagaagggaacagatactggggcctatttgaggatagagggtaggagagaggaacagaaaggataacaattgggtattaggcttggtacctgggtgatgaaataatctgcacaaccaatccccatgacatgaatttacttatgtaacaaacctgcacaggtgcccctgaaatgaaaataaaagttaaaaaaattggcgctcattgaaaatggagaagattttaatctgtaaccctgtaacccctttctttcctaacaaacatttttgaaatatcttagaggtaaatgattgcatttatataaattgcagtaaagatgaaaaataagaggaaataaaacaaaaatatatttagttaatagctaagtaggagcaaagtgatccaatgcataactccaaggagacttagcatctgtgcactgaaatgcttgttttaacaagtccaactgtgttttctaactatgtcaatcctctttcccttggctagtgcagaatccagtttatagaatatatcaaacttcagccttcttgctgagaggagctgaatgctgctttaatttcccagccgggagctggtatttcagcatgaaccaggcatatttaattgttgtgtaaatgttaagatcacaatgtaggccatatggcagtttctctttacagaagaagagagaccttcaaatcaaactgttaagtctgagaaccatttgaagtcacagtcattaatttggagatatggacaagagatttatttctcttttctatgtgtttcttcctccttcctatgcaccataagagagatgggtctatttaaagtggaaaaaacaatgtaggtcaattctattaaactctaagtggaacttccacaagtttctatttcataatggtgggggaaatgctactttaaaatcaattttctaagtccatattagggtcatgcttcactttggaatgagctggagagattccagatcatcagaaatgagtttcctgaggtgaaggagcagaagtagctccatataatttttttctttaaaacaggtcacattttccttcaatttgccatctccatctcaacttttctttgacacactactattcaatttttacaactcagctcagaagtgaggtgggtactcttagggccttgaagattttgtttaggcacaagtgggccaatgcacatggctaatgcaaagaattgaacaataaatccaaaatatctttctaaaatgttattctctgtgctggaaatacaatttcacatcctctgcggccttttctcattttcactcttcttatattattatagacgtctcacttggaagctggtgggaactaggtgtattcttaggtatttctgaggtcctatagacttagacactttcgaagcaataaatctcatttggatttattaagggtatttcgcttaaacattttttactgtattcagccctgagttattaaaggtatttatattttggcatcttattcattttcatggtccctgagaaaaatttcaagattgttatctgaaaaatgtagccaagatcaatcaccaccagtttctgtcctcttcacgatttcagtgaaaaaagatcttgatttaaagatgttcctaattgactaatgatggcaggaatgttgaattttgttttattttctaggaccatccatacccccttgcagaactggaggaagtagaggtctacatttacacaaaaacatggtaactgtgaccatgaatgattcagaatgacccaggatttgttctgcagcaccttatgattatcttataaacaaatcatcagatgtttgccatcagttcctcatcttctctgataaactttctttatagtttggggagacaaacacacacggaaaatttgtttttaaagaacttcagagttaaggaactaaaaaaaaactaagtttctaagattctcagaaactggaaattaacttttatttagataattctgtttctcattatataggaaaaagttgacagatataggagacaagacatgggagtattattttgtgtcttctctcagtggcaaatcgataatgataataatgttatctttacctacttatatggtttaaaaatatataccttattagaaattataagtgcaaacattatatcctttctgttctccaagttataatagtacatgcacaactatgaatattattatgtaaaaatgatttcagtatttaagaagtactagaccaaaaatttccagtttcttgaggctggaagcattggagattgctctgtagtaacaagtatcctgtaaacttcaagaaaataagaacttttaacatatttcaaatctttacaataagaggataaatgtgtactgaattaataagtccaccactgcattgtaaaatgaatgcaattaagattttaaaggctatttctaagaagtgtctgatgtgttttagtcttcatctttctcactcatgtccaatctgactgtattattgtcagcgactatcaactgacttgttagtattgaaaatattagacacatcttttgagattctattcatttctttggggtacaaccacatatccaagcaaagggaactacttagtgcataccattaaaacattaagatgttgttgttgatgtgtttctcttgtaacatatggtatgaggtacaaagacaattttaaaattacttctggcattttaaattttcaaaggacatcccaataatgtaagtttaatatacactgaaaaattggtgatgaaacgcaatttaaagtgactaaatgttttctactttattattttttgctgaactgttctgactgacaattttattcttcccatgtaagtaaattcagccatggagaagtgtctccatggataatagataggtcagaacagtcatacttaattgaagtatgcttagaattattaaattcatattatttagcaataggctagaaggtatgcgtgtgtgtgtgtgtgtgtctgtgtgtgtgtgtgtatgtgatgtgttttataattcaatagaagtgggaagaattcttattttctgaaatgttatagagtaacattattggtaacaatgttcagaaaatttacctgttactgtaggaagagcggttacctgtgagtgaaagtcccagccctgtcaccaccaacctctaggctcatacatttctcaggctcctcattcgtataagaggattagataatgaataagctccctctaattctaaatttacaaaaatgtttatgaataatttagtgtatgataaatatatgccttccattttacttctaaagcatatgagaaacataccaaaaatgataaagattatatattcttgtagttattttaatatagctgagttatgtaatacatatggaattacttagcacaatgcctggcacattaagaactagttgtttgaagagtttggattttactaaatcctagagtatgatttcttatgtgtgtgctcacaattcaattttgtttatagtgaggaaattagaattttcaaagttgaggttatctctagttttaaaaagctgtcatgattatttattccacccttacttccccaccatcagacacacacacacattgatatagagtcattttcattgctataggattaagactaacacatagtcaggagaaatacaaattgacaattagatctccagtgttgattcacttgacacgagccctgaatcaataatgccccagtactgtcttttacacgcatctactgctttatactacactggccctttcgcttatgctaatgcctaacatcatggcacagactgtgccaggtactgctctaagtattttagaaatattggatcatttcatcctctaagcaaaccctagtgaggtaggaattaacattattccagttttacaggtttggagatattcttggggaagatctgtggctttcccaaggtcaaatagcatctcagggtgcagctgcatcacctacactcttaaccagtatcctctcatctcccaccacatttcaaggagcttcacagtccaaggtctgacaatttctactttatttcactatccacgaaaaaaagtggcagttattttttaaccaccggagcatgaatcatcacaaatctcacctacctccatttctttttaaattgctaagtgcttggccttgaaaacactcacagtgataatactacaaatgaaatgcagcccttctttaaaaatactgtgaactagaataggcaagaagacattttggatgtttcatgccaaacaacctggcaaaaaagaatacacccttcaagagtcccattctaacggaatcattggtctgaaaggggctgtagaaagcgtctgtcttaataatctcattttacacatgatgattctgagcccctgggtgttacacatgttaggtcctatctacggaaagaaaactagaacctggctctgtggatgctgagcacactgccacatcatgctgcctcctaatccttttatagttttgattgtaaatatataatttagtaaattaatttgcaatattatagaaagaaagaatcaggcattaaatcgtgcttaggttccctagacataacttgtaagttgcatgtggtgcatagtttagtagggagaatcctggtaccattgcacagttctagcaatttggacctttggacttgaagggagggtctaaatttaagagtaagtaaaacctgggcatagaataaaaagcttctgttattagcacagggggaaggccacatgggaaaggagcaagctagagacagagttgaaatgagaacacagtgagaaaccagccatctgtccaccagcaatgaagcacacaaagtaaccgcaggacatcattgccttccaaatgaacctattcatgtagcagattcctaagatcagtcctttactcataagctgtgtttttggggggcattatacaatataaccttaagaacattttaaacctaaatacctcacaatgataaaaagcccattatctttcctatggacatattaactattctttagtataaaaatatgacttagaaactgaaagatttttaaattgcttccaaatgtatacttaatgcctcacaatgtaacacttattattcatacagaaagatggtattacttcaccttactttactttgggctgagaacagagaataaaaaaggtgagtggagaatgaaagtatattaaaaataaaattttgtaccctggttgctttcatgcagttgtacttgcatactttgttgaagtgtgccttctcagagacatttatgtcacttttgtctcctagactccacagatacaatggagcattataataatccctaaagaaagtaacacaacagaataatagtttgcacaactttatccaaggaactcaaagtactttattaatgttagctcattaatcacaccagagtgtggcaaaggatgaatacatctgctgaaacagggcaagagcatcttactcagcaaagttgtagtgagactcaaaagtcaaatgggaggctggagagcaaatatacaggcacagaaaaagaaatgatgtcaaaggaatcttcttattctattcagcactgtattagttcatttaaaatgcggtaacaaattactatagagtaggtggtttatggacaacagaaatgtattcttacagttctggagcctcaaagttcaagatcagggtgccagcatggtcaggttctgatgagggccctcttctaggttacatactgccttctttgtattctctcatggtagaaaagaagctggctggttctctgcctgtttatattggggcatgatatggtttggctgtgtccccacccaaatctcatcttgaattgtagctcccataattcccatgtcctgtgggagggacctggtgggagaaatcatggaggcagtttttcctgcactgttcttgtgacagtgaataactgtcacgagatctgatggttttataaagggcagttcccctgcacatgctgtcttgcctgccaccatgtaagacattcccccacttctcctttgccttctaccatgactgtgaggactccccagccatgtggagctgtgagtccattaaacctctctttctttataaattacctagtcttgggtatgtcttaattagcaatgtgagaatggacaaatacagggcactaatcctattcatcagggttccaccctcatgacctaattaccttccagaggccccacctccaatgtcatcacatttgagactacagtttcaacatatgaattgtaggggacataaacattcagtccttaaaaagtactaagtaagatattactgaaacactaagtctaattatttggtttacatttatgacttctgttaagaatttgtagggaaaacaaaataaataagacacttttgtgtttaaaaattgtaaaaaaaagacaccatttattagaagaaaagtttgggattagttaatttaattttataaaacttattcaattaaaggtggctccaaaagtagatccaatgctaccaatatttactcagtaaaaatcatgtgttagtcatgatgctgagggtgcagatacaaacagaaacataacatgatcttttacaagtctacagtataatgggaatgttatagtctcatagtttccatatatcttttatataaatgctgcaaataatcatgaagaaacaaaagagatgatgagaaaataaggaaaagactataaataatatatgaaaggaaaaaagaatcttaaaagtacagctttaatttggtttcaaatgtctttcactgaaatataggttattcttgtcataataatgtaggcatatactcattgtgtccatcagaaagcttgaaaatgcttcataaaacacaatggcctaagtattatttgattttctcactatcaccatctttcatattttaatttttattcagccaccgaggtcatatcttagactttgttatcaccaatagcttaactaattccaaaacctctatacagatcatttcttctatttccagcttactttattctacttctctacctccaataacttttctctctcatatggacctgtagttcattaactctactctttattcactgttcactaccttcccacatgaagagttcttggtctatcactaagatgatcaccttataaatatatcatgttctgtgtatgcccactcgttctgttttctggacaccacaccgagctcatcttttataaatctttcaacctatctctctggtttagcaaagctggcatccttttgctcttggaactgaccacctctgttttcacttcaggagatttgcacttgttattccccatgctgataacgtttctccctcagattgttacatgactagctttctctcttttttattttatttattttttgagacagagttgcactctgttgcccaggctggagtgcaatggtacaatcttggctcgttgcaacctccatctcctcaagggatcctcccacttcaggccccccaagtagttgtatgtgctaccacatccagctactttctgattttttgtagagacagggtctcactatgttgctcaggcttgtcttgaactcctgggatcaagtgatcctttagcctttgtaccccaaagtgccgggaatacaggcacaagccaccacatccagtgctgtcccttttcattaagctttctgcccaaaatattcttttattaacttgctttattattttttatggcatcaaatattatttgaaattattttatgtatacatttgtttattgtttattttatgtcctttcaatagtgcataatatccatgaatgctagaattttattttattcactattgcatgacacaaatttagaatactatgtggaatacagtgtattttcaatatccatttgttgaagaaaaaaaaggaaagaagaaaggaatgtaatttatttgccccattcctgaaataaatgaacactcttagggatatattgggcttaacatggaataacaattttcatttataccattctagatacaatttccttgcaaatctccattatcttaatcttacaattgataactattttgtacaatatgctgggcactagtcaaatatggctattaacatttaattcaatttaaaatgattataataaataaaaccaaatacccagttcctcagtcacactagccacattttaaatgctcaactgctatatattgacagtggctagcttttttaaccgtgttaaatttacaacattttcatcacaacagaaagttctgctagacatcattcctacagattctattgttttagattctaggactatattatctgatccctaataaagtgagattaatttgaaattagaaaacaatttaaaaggcataaactctgaatttctcagaaatcatctggtatgtttcattaagtttagattgtactttatcattatcatatgtataaatttcctatcttcaaataaagaatgagactaacaaaataatattattctcaaagaatgagaataatattaaagtgaatgggatgcttcactacttttctaagtttagagctggtgacaaagaagaagaaataaagattaagagcagtgacaaagaaaatatatctatccattcatccatcattcttctacccatctactcattctttataaatgttcttactgagtgttgttcacacactgtgctctggttttacatgtttaaatttgaagaaatcatagtgtttaaactcagacaattgataaagtaatattttaaatttacatatgaaataataattgaaataattcaataataggctaaatgctatgaaagcataaagagaaaatcagtttacctaacaccagcacaaagagatgaaaacacatttgaatgtatgtgtctttataacagaacaatttacattcctttgagtatatacccagtaatgggattgctgggttaaacggtatttctgtctttaggtctttgaggaattacaacactgtcttccacagtgattgaactaccatacactgacatcaacagtgtaaaactgttccttcttctccacaacctcaccagtatctataattttttgatattttaataatagccattctgactggtttgagatgttatctcattgtggttttgatttgcctttctttaatgatcagtgatattagccaggcatggtggtatacacctgtagtcccagctacttgtgaggcttaggcgggaagatcacttaagcctagaaggtcaaggctgaggtgagcctgggtgacagagcaagacatggtctacaaaaacaaaacaaaacaaaacaaaacaaaacaaagcaaaaacctctttaaatgtggtcctttgtgaactagcacaggaatataggaggacccaggattgtaatatgaactttttaggtttctccttcttcccctccttctctttttctattttattaaaaagagaaagacattttgacttcaaaataaaatgtcttcttaatgttcatcctaattttcctaagtatgtcagatatttggcattgattcatttataaatgactttataaagacacagaactctgaggtgaggataaagtgactagcatctctctcacacaatgagttagcaaagcttcagcttgtgattgtgtattatttgacatttctaagtcagccaagacctgacaagaaaagaaaagatctgacagagttgtcttaccagcatggacaaaattacttcatttaccctcacctaagaggataacgaatgaggaaggaaaagaaaaattaaaaaaaactccataaggagattaatcgttctttcctacggctgcctcttcttcctgctcctcataaatgtaatagaaaaaattgagctaatcaaattgttaatttgattaactatcaacagtttccttatgccttctagaaaaccagcatgaggttaaacaaatataatatagaagtagagtaaattgccaactgcagattggcagatgtttcagtcctcttagagttaacgaatagtcacggtgaccatgattgcctgtggttttttcgaatcggtgtctctaaatttaaaaatgtcaaataatcattatctgcccaaatgtattttggtcataaaaatcctaaatacatacattaactctgtaaagtatctgccagtcccttcacagcttgcgaaatgtccattattaaagcagcatttaacaacagtcatgaaaaatatttcctttctcatgggtttgtttcacattatcattccataaaaagaacttatgggacagacattttgaaagaaagaaagttaagagactgaatcaattagaacactttggcgtggaaagataaatgattgttaagaggtgaatgagtaaaggagatattaataataatcaaataaattatattagaaaaacaaacttttctttaaaatcaaagtattggtacaaaggtatattatttgacattttaatatggtttgttaatggcattttacttagtggataatatatttacagtatgattaccttaatagcatggtcatataaaacatatgaatagattacaaaacagtttagtgaattccatggaaattaaataaaagggccatggatagatttgaagtgatatattggagaataatcatgcccctcttaagaggcagtgaggtattctggaaagaacacaggcttcaagttcagaaacaaactgagtttgaaacctgggtttctcccttctcaagtccatggccttggccagcttgtttaactgctttgagactcattttcctcatatttaaaagaggatgatgagattataaaatctaactcaaaggaggagttaagcaggagtccagacactccttttgctacaatcaaaaccatcactccttgagcaccccaacactcaccacaaccccaacactcactcaccacccaactggcctaagctatgtagacaaatctccttaagctctttatgcccattcaccatcactctcaatgggaagcctagaactcccaggtaatccacatgcctggattctaactccaatatggttgtcacctttttgtaacgtggcttaatatttttagtaatttccaggtttctttattaaattcttctttataaaatataaccacccactaaaatataagttccataagtatgagtggcatggtactttttgctcactgctctatccccaggccttatgaatgtgtctcacacttatatttggttcatttcctcatactctttctgctacaacactacgtaagacctctgctaagaagactggatgaggtggtgcatgagtcacatgcctcaccaaaaagtaaaacaaaatatctgaagttaaaaaattatactgatctagaaacatactcctgcattattgtagatataaatcaagttatgcacagaattcaaaacttttgagtttgatctttctttaaataagtctccttagcttactattctgccctccattttgttggggtttaatgtttggtgaactgattatgtttatttagttagatatattagaagagtgaaaagagcattcctcagctaatgtctggttcttctgcttaacaatactatgaacttgtcatgctcaacttatacaaatacaaaactagtatagtataaaatttggtgttattgatgtcaagatttcatattagataatgaaataggcagggattgtataatatgtatagcttattaaataagtacatgttattagattttaactgccttacattatcttctttgatgtctaaaactgcatgttgatattcaaagtaatgtaaacttattttttctgtaaactgcccataaaaggcttgtgcttctggtacccttgaggtccaccagtagccaccccatgtcatcatagtgaaaatatgaatgagattaaaagctctgaatggaaacaaaatagtattttacatactttcttactcaagtgagttgggttaaacaaataacaatggaagaatattatttttctcatttttacatggaacatttatcaagagttagggctataaaacacacctcagcaaatagaaaataatgagaatcatacaaggtaaaatttcagatcacaatgaactaaactagaaaccaacaatagaaagacagatagaaaatccctatatatttatcacactgaaaaaccatatgggacaaggaaaaagtctcagataatattaaaaaaatgaaagaaaattaaaatatgacaccaaatttgtatgaggcagaaaatgaagttcttagagaggaatttatactacatagtattagataaatatattagaatagaagaaagattgaaaaatcagtattctaagcttccatcttagcaaaatagactaaagaaagcaatttaagctcaaagcacaacgactaagaataccataaaaattatgatagaaatcaataaaaatgaaaacaggaaacaatgaaatgcaactgtagctcttggaaaatatattttttaagattctctaggaagactgaccaagaaaaaagaacgtaaacattatcaacatcaaaaatgaaagaggggtcatcactattgatcctggggaccctaaaagagaatgattcaagcaaactacagagaactcagtgtccataaatttaatttagatgcagtggagcaattcctggaaagtacaaactaataaaattcacataatgagaactatctaacctaaataactttatatccacaaggaaattggatcaatttgctgagaccagctcggtcagggaaaccctaacccagtggagctagaagaattaaagacacacacacagaaatatagaggtgtgatgtgggaaatcagaggtctcacagccttcagagctgagagccccaaacagagatttacccacatatttattaacagcaaacctgtcattagcattgtttctatagatattaaattaactaaaagtatctcttatgggaaacgaagagatgggctgaattaaaggaatacgttgggctagttaactgcagcagggacacacccttaagacacagatcgctcatgctattgtttgtggcttaagaatgcctttaggcggtttccaccctgggcgggccaggtgttccttgtcctcattcccataaacccacacacttccagcttgggcattagggccattatgaacatgttacagtgctgcagagatttcgtttatggccaattttggggccagtttatggccagattttggggggcttgctcccaacatcaattattctatgatcttgcaaaaaataaatcaccaggcccaaaagttgtcaccagtaaattctaccaaatatttaaggaataaatgatatcaattctccaccatcttttccagaaaatggaagcagaaggagcactttcaaatccattctatgaagtgagaatcagcctcatacaaaaatcagaaagcacattacatgaataaaaatgcatagaataatatatctcataaagatagagacaaaatcatgaccaaaatattagcaaatccaatccaatacattttcacattttgatgcaataaaagttattttaggcatgcaaggctggttcaacatttaaaattaaaatcaatcaaaacaattcaccacattgacagactagagaagaaaaaacataggatcacagacttggcatagaaaaacatacatttgacaatatccaacactcattcatgattaaagaaaaacttttagaaaagctgtaatgaaggataactttctcaatatgattaagaacatctgaaaaaaaaactgttcaattagcatcatacttaatggtgataggtggatgctttctcccaaaatcaagattaggggaaagatgttgctatggtttgaatatgtgtcaccttcaaaactccttgaaatttaatacccaatatggcagtactgagaggtgaagactttatgagttgactggctcatgagggctctgcctttatgaactgatttatccattcatggattaattggttgatgtataaatgatttataatcggagagaactggtagctttataaacagagaaagaagaacttggtcttccacatgagcatgttcagctccctcaccatgtgataccctgcaccacctcagggctttccagatctttatttcaattaccattctccaattacagaatccaagcctccttgaagaaatgaataattttagactgataggaactattcaagatgagccaggagcatattgtggtaacaggaaataagaaaaaatttacccacaataatgaggacaaagggacagaggggctaattggaagagatcccaatagccaaagatgaaacaatctgagcaacagaattaataaagtagtactggattataacccaaattataaaataaatatatccaagtgtccatactgatacaaaaaggattgtataaatcaataaataatgaaagagaataggtaaatttcctgttcaggatgatttcaaattatttatgtcatacgtggcctttaaggaagtggaacaatactccccgctccttacttgtgggctgtgcatggtgactaccttccaaagagtacagtatggaatgggagggaaagaaaaattaactttacaatggagatgtctgacaaaccctaactcaagttagatgattaaggtcaacatcaacagcaataagatatattcatagcatgcactctcaatatgatgtgatgagaatggtactttaagtctcgtttttcttcccaaaacaattactccgatctaatcttgagaaaagcatcagacaaatcccaattgagggacgttctacaagataccttaaccagtgctccttaaaactgtcaaattaatcaagaagaaggaaattccaagaaactttaatgattaaaagtagccaaagaagacattactactgaatgtcaggtggtattatgtatcagattctgaacagaaaaaggacattgggtaaagactggaaaaatctcaatgaaaaatgcactttattaagtactttaacagttggttcattagttttgaccaacataccatagcaatgaaagatgtttacattggaattatctgtatgatctttgcaataattatgtaaatataaagcccctgtaataaaaaggaagtaaaagtttaaccgtaaaaagggaaccatatatctacatcaatatcttcatctctcgctctctgtctctataactatttttaatttaaaaattattttgaatcatctggggatttttttcaacatactggtgattggatttcaactccactcaattatatgagaaaatatagtgtaggtttttggcattggcatcaaatttttttaaagctttccaggagatagtaatgtgtactcagtattatgaacaattgaattagatgaactgaatgattactcctaaagaaatagaaaacctgagtattttaataaccacaaaatacagggaatcaaacacaagtggctttatttgtgaagcctaacaaatattcaaataacaggtaatgcctagattgtttaaacttctctaaaacagcgaatactttttgaaaaagttttattattctttctaagaagtgagcataacctgatatccaaagtcatctaggggatcacaaaaatgactccaataacaacaacattatagaccaatctcactcatggacagagatgacacactatgttaaagaaatattacatcaagaaaaaatagtttttatctcagaaatgatcttatggtttaacacaaggatattcagtgatgtgattcactgtactaatagtttaacccacataagtccagggaggaacatattccagtctttgtataaaaccttagtcatattaccaaattaactgtaaggtatttaaaacctcctctgaattcacaaaacatatgtcgacttcacaaatcccatctttgtgcataataacacttcaaaaaattctttttaaatgtttcttctacatattcatcaaatctccagaaactgactcaaagacttttcctcctacaaatttatccccaaacctggcctatacatatacagttcactacttaacacaggtttgagctaggcaagcccatttataggtggattttcttctgcctctgccacccaagatagtaaaagtaaccccttctcttccttctcctcttcatcctactcaacataaaaatgatgaggatgaagaccttgatgatgatccatttattatgatgatctatttattatgatgaatagtaaatatattttctcttccttattaatttttaaatattttatattctttagctaacttaattgtaagaatacagtatctaatatatacagcatacaaaatatgttttaatcaactatttgtattattgttaaggcttccagccaacagtaggctactattgtcaagattctgcagagtcaaaaattatatgcagatttttgacagagcaggggttggtacccctaatctccacattgttcaagatcaactgtatactttcatttcttatcccatctaacttcaatactctctttctttttccccttcattcaaacattaattctctgcactttctaaagcaggccctgttagattcatagcttttcctaatctgcttttttcttagaataacccatacaaaaggctaaggggccaatgagacaacacagaatcattttaacaagaaagaatagtggaagaaatggaaagcttcaaaatggaacttcaaaattttccttaattggtgagcaggaagttaaagaagttaattaatttgagttaatatgtttcactcagccataatagattaatgggttataacctcatggttattttgataaagttaaaaaaattcacttaccaaaattcaaatatttcctaataaatatatcttagctgtaaatgaggaacatttcttaaagtcagcatattattaaggaatcatttcaaaagttagcagaaaggatgaaatccttcattaattattttggaaaaattgtctctttggggtaaaaaagggggataatatagaatatttcatattatactcacaaatatactttggttgggttaatactaaaaaatgtatttagaatatgtataataataaaatataataaattataataacagagtagtcatgataaaatgtagtaaaactaaataaaatagataaaaatgtgaaaagcaattccagtcaggtgcggtggctcattccagaaattccagaaatttgggaagtcaagggaggaggattgtttgagcccaggagttagagaccagcctgggcaaatggtgacatcccgtctctacaaaaaattaaaaaataggaaagcagggcatggggacacatgcctgtggtcccagctactagggaggctgaggtgggagaatcacttgagcctgcagagcaaggttgcagtgagccataatcatgccagtgcacttcagcctaggtgacagagagataccctgtcatttaaaaaaaaaaaaaaaaaagaaagaaaagcatttccattatttcccagtgtgtaaaacccgcttacagaacataaaatctttaatgccctaagaaaaaataggcagatttaaatcaacaataatgaggatcaaaataatgacagatattgtaaatgcaattaagaaacaagcaacaaattaggagaaaatagttgcatcatataaaatatatatctggaacattcctataaattagatttacgaaggcaaacaacagagtagaaaaatgtgcaaagaataggaacaaaaaaataaatccaagcaattagtaactctaagaagaaatttctcagcctcccagaaataacaaaaatgcaaacagaaatacaaataattagggtatgtccttttgtttattaacaagataatatggtttggctctatgtccccccaacaaatttcatctcaaattgtaatcaccatgtgttaagggcggtgggacgtggatcatggtaatgggtgcccccatgttgttctcatggtggtgagggagttctcaggagttctgatggtttaagtttcccctgtgctttctctctcctgctgcctgtgaagaagttgcttgtctctccttcaccttctgctgtgattgtaagtttcctgaggccttcccagctatgtggaactgtgagataattaagtctctattctttataaattacacggtctcaggtatttacagtagtgtgaaaatggactaatacacaagacaaaactaaaactgaattggcaaagcaaacaggcagccttatcaaagaagcaatttggtgttatttgcctaagtctaaaaataagatcaaatagtctttgacccagtaaatcaatttctaggcattttttgtacatgtgtagaaacatatatatatattttatatatataattttaataaaaattggagataaatatggtttggctgtgtccccattcaaatctcaacttgaattgtacctcccagaattcccacatttatgggagggacccagggggaggtaattgaatcatgggggctggtctttcccatgctattcttatgatagggaataagtctcacaagatctgatgggttcatcaggggtttctgcttttgctttttcctcattatctcttgctgccatcatgtaagaagtaccttttgccttctgccatgattctgaggcctccccagccatatagaactctaagtccaattaaacctctttttttcccagtttcaggtatgtctttatcatcagtgtgaaaatgaactaatatagaaacaatacaaatttctgtaaatttttagcaaggtaaattgccatctaactacaggctacattttgcagccttccttaggcctgaaggtgatcctataccaattctgggcaatcatatgtgaatagcaatgatttttgcaatttctgggcagtaggaatatcaaacagaagctgttagtttttcatttcttctattatttctgccccattatatgggccgtatcaaaacatggtggagaggaatcagctcctcttgtggagatgacaaaaacgaaacaaaacatgttagtggatggatggaatctaggtcaccaaattatactttccatttgacttaagcccctattatttggttccagataaagaggttgaaataatatctcaaccaatgtagtagtaaatgcacacacattgagcctgtgactctgaaatatgaaaacactgttatagacacttttatcagaattcacatacaggtttacattcaaaaccaaaaaactgacatgctgacatctccaaaattcttaaagatacaaatctcaagcagtttagatttcatcttagttgcatcttttttactaacctccaaagtaagagccatctgtcagcttcatttctttactggattttgtaatgacaccagcaacaccgtgttgaatgaaatacatttttttacccacggctccttctcgtatgatataatctccaggttgaaacacctcaaatctcaacttgctcagcatggcagtcacaaaattaggatccgcattagcaaataaaggcattgtagccaccagtttccgacagttgaagttgactatctcctaaagatgtcaagagtaaacaaatattaagagagatattaatcatatctggaagaaaaacatgctgaaatttaaaatatatacagcataacattgtaatttaaatttagatacaaaaattcataaattctagtaatgcgcatcatattacagtcaggattatgttttatttttatgttgaaatttttgtattcccagcacctagtgtagtataggaatgtattaaatattcgataaatgttaattcaatatatgaaagtctcaacttttttaacttcccatttctttactactgtgtatatgaaactaaaacttctaaaatgtgaatacattctattcttccttttatcttttatttacgaagaaagaaagccatatcacttcctattagctatgccattcctgcttctgtgctcctttttgtctgggcccagctaccagacaaaaacattttgatgttttttttttttgttagtgtcattcacattagagtgaggacaatggatagtacagaaaaaggttacacaaaggaaactctaatctaaaagtataaattcatcaggtgcagtggctcatggctgtaattccagcactttgggaggccaaggcgggtggatcacgaggtcaggagttcaagaccagcctggtcaagatagtgaaaccctgtctctactaaaaatacaaaaattagctgggtgtgctggtgggtgcctgtaatcccagctactcgggaggctgaggcagagaattgcttgaacccaggaggcggagattgcagtgagccaagatcataccactgcactccatcttggacaacacagtgagactctgtctcaaaaagattaaaaaaataaaattataaattcaactggtgtctgggctagaatcagaaatcattctttctaaagactcctgggattcccctgcaagtgatgggctagagagaggacatatttgccttttcctgacttgtttgttttattccaggatcaggccaattctcaaataggagatctgtatgtttgatttcattctgtggattctgatcaaggttagacatatttttatccctctggatgaaaatagaaatatggaaccaaacatttttaatcatgcaaatcacttatgtgacacagaagagacagtggaaatttacatttttgccacaaagccaattctcagaaatttccttaccaattagttaccccaaaaaaggttgggactgcatttgtgattttgtgtaagagtcacagaaattggtcatgtctgctaagaggtgaaaagaaggcagaaggaatcataggtattaacagagtctgagaactctatcttctgccttggggaaatgtgctataccgacccatcaattccaagactgagaaagaaggtttctatgatcttacttcataaaataacctaatgccatccaggatagataaagaattccaggtgataacagaaggcacaacattttgaatctatcttggaagagaaggtgtttcatcctgaacaatattttatgagtttagcaaagcacaacaatgtctgtaatagtggagcttcatggaagatgagaaaatatttacaaataagcaacaataatcagaaagtgaacctagcagcaaagacaagagaaagatattacatgtggtacttggtgcatcattattcaaatcaaaatacacacttgagtccacgattggctgtatctagggaaatttgtgataattttagctgatgcatggagtgtgggtctataacaatgttcagcaagtagtaagtactgaatcaatatgcatgcatataaaggaagccattcgaaggaagaaatgaaggaggggaggaaggaaagaaagaagggaggaagggagggagcaggtgggaaggaaagaaggaagggataaaagaagaaacagaagaagggagggaggaagaaaggaaggaaggaaggaaggagggaaagaaggaatgaaggaagcaaggaaagaaggaaaggagggagggaggaaggaaggaagggaaggagggagggaggaaggaaggaaggaaggtggagtctcagttgtaaaaaagtactcataaagactaattttctcgttgggagatggttacttaaaactcttagctttctcaagcaaatggcttgagagacaagtcttctgtattaaaaaatttgtttttactatttcaaatatttctatacaaaaacaacaggaagataaaaggtgacgtggagttaaaagaagacagagttatgtcatgaaaatagctagatgagttgattgagagttaattatttcacatgtaaaatgacagaataatactgtgtaggaaattgaaaataagtcagattgtagagaaaataagagttttcatataaaaataatagagaatcccttcatctttgtaccttgatttgaactatgcaaatgtttcacttcatggatctctcattttttattttagaaaatagttggaattatatttgataagcaattaacctgatctttagtcatatgaataacttgttaatgatacattgcatatccaggtgtttctgttagaactccctttattataacactactggaataatttcatattattgtttgaagaaatctattaatgttttcttccttcatgcaacttttacttcccaggagtattacctgattaaaactgtaaattctaacagatatgatagaaaaaatggtaatgagacagaatcttcttggattctaaaaacctttcattctcccatgaaaactgcttgttctgaggatgtctagtatagtagaaacaatcatgtaagtatagaatgaagcaaaactttaaaaaaatatttttaatcaatcacctttccttagggcacattgaggcaaataaaacacactgttactatctctaatgtcaattcaaattacttatggcacttgttataattagctctttttatcaaaatatcaggattgagttaggagtattatctatgtgcattaaattgaggaaaggttgcttgctaaggaaggcaaacacatggtcctgaccttagtaataagttgctccagattattaagtttatgttggcactttaaaaaatgcaattatttctttcctggaacattttgtagtacaagaaagtatgtacatggtaaaaacaaatgaaaaaacaaacagaaagaccaatccccaaaatgaaacagaacaagaaccccacagtaatgaaggtatttcaaagggacacaggggccaactgaaagagttaccaacggtcaaacaaagctggaaaaacttgagtaacaacaataaaaagtattggattaaacccaaagtataaaataaataaccaagatcacatacaaatctaaatgattggttaaactactaaaaagtgagggataatacataagctttctgtttaaattccaaataatttcaaataattcatataagcactcctgcctcaaaaagttggagaataattaccaaacccttaaggatgggctgagcattgagcatggggacttccttcaaagaatacaataaggaaaagaggggaaaagtagtaactttccaatagagaaacatgaaaaactccacctcaagtcaggcaatcaatgttaacatcaacagtgctaaatcatgttggtagcatgtactcttggtttgatgtaatcagaagagcattttacttttgtggcattcctacaccaaacccataatcccattttaatcatgacaaaaccatcagcaaacccaaattcaggaaagttctgcaaaatatttggccagttctaaagatgatcaaggtaatcaaaaacaaggaaatttggaagaaactgtcccagacaaggggagactaaggagacatgacaagtgaccataatgtggtatcctggatgggatcctaggatagaaaaagaactttaaagaaaactaagggaatctgagtaatgttcggacttaataataatgtatcaatattgagtcataactgtagttattacaaatgtagcatactaatgtaaggtattaaaaacgggggaaattggatgtgatgtacatgggaattctccatactatttctgaaacttttttgctgatatagtttggatgcttggcacttcatgtctcatgctggaatttgacccaatgttggaggtggtgcatgggaggaggtgtttcagtcatgggggagaagaacccacatgaatgatttggtgctgtccttgagttaatgagtgagttctcactctattagttttcatgagatctgattgctaaaaggtgtctggcacctactttctctctcatgtcctctctcatcatgtgacatgcaggctccccttccccttccaccatgattgaatatttcctgaggtcctcactagaaacagatgctggtgccatgcatcttgtacaggctgctgaatcgtgagacaaataaatttctttataaataactcagtctcaggtattcctttatagcaatgaaaaatgaattaagaaatctgcaaatataaaattattctgaaaaagcttattaaagatgtaattactgctcttcatagttaagaaaataaatatgattttgtcatagcatgtaaagcatattttctttaagttaactcttttaaaagttacttttaaaaagatctcctagtaaatgcttgaaaacaattatatcatagtacagtctggggttaagcagcaggcctggaatgtgtctgtttatattgttgtggagttaataactgtggtctgtcataagaagacaaattgtatatatatcatgcattttcaatttcagatatatgtttctatcaagtttttatttacaaataaaaatctataattatttctgtattctgttccattgttctatgagtctgttcttgtaccagtaccatgctgttttggttactgtagccctgcagtagagtttgaagttgtgtagcatgatgcctccagctttgttcttttttcttaggattgtcttggctatttgggctagtttttggttccatatgaattttaaaacagttttttctagttctgtgaagaatgtcagcggtagtttaatgggaatagcattgaatctataaattgctttgggcagtatggccattttaacaatattgattcttcttatccatgagtatggaatgtttttccatttgtttgtatcatctctgatttctttgagtagtggtttgtactatccttttagagatccttcacttttcttgtcagctgtattcctagttatttgattccttttgtggcaattgtgaatggaatgtcttctgagatttatccctcagcttgactgttgttggtgtacaggaatgctgacacaatttttgtacattgattttgtatcctgagactttactgaagttgcttatcagctgaggaagctttaggctgtcataatggggttttctagacatgggatcctgtcattcgcaaacagggatagcttgacttcctcttttcttatttggatgccctttatttacttctctttcctaattgctatggccagaacttccaatactatgttgaataagagtggtgagagaagataccctagtctggtgctggttttaaaagggaatacttcagcttttgcctattcagtatgatgttagccgtgggtttgtcatatatggctcttattattttgaggtatgttccttcaatacctaatttattaacagttttgaacatgaagtgatgttgaattttatcaaaagcctttcctgcatctattgagataatcatgaggttttgtctttagttctgtttatgtgatgaatcacatttattgatttgtgtatgttgaaccgaccttacatccaggggatgaagcctacttgagttttggtggataagctttttgatgtgctgctggattctgtttgccagcattttgttgaggatatttgcatcaatgttcatcaaggatattgggctgaagttttctttttttgttgtttctttgccaggtttggtatcaggatgatgcttccctcatagaataagttagggaggactccctccttttcgactttttggaaaattttcagtaggaatgctactggctcttctttgtatatctggtagaattcagctgtgaatccatctggtcttgggctttttttggttggtaggctatttattactgcctcaagactaaatgtaaaacctaaaactataaaaaccctggaagataaccaataccattcaggacataaacacgagcaaagattttataatgaagaccccaaaagcaactgcaacaaatcagaaattgacaaacgggaactaattaaactaaagagcttctacacaccaaaataaactatcaacagagtaaacagacaacctgtggaatggcagaaaattttgtaaactgtgtatctgacaaatgcctaatatccagcatctatagtaacttaaacaaatttacaaaaaaaaatacaaacaaccccattaaaaagtgggcaaaggacatgaacagacacttctcaaaagaagacatacatgtggccaacaagcatatgataaagagatcaacatcactgatcattaaagacatgtaaatcaaaaccacaatgatataccatctcacatcagtcacaatggttattattaaaaagtcaaaaaataacagatgctggtgatgttgtggataaaaaggaacgtttatacacccttgatgggagcataaattagttcagacattgtggaagacagtgtagtgattccttaaagacctagagacagaaataccattcaacccagcaatcccattaccaggtataaacccaaaggaatataaattgttctattataaagacatgcatgcatatgttcattgcagcacaattcaaaagagtaaagacatggaatcaacccaaatgctcatcaatgaatgactggataaagaacatgtggtaaatatatagcatggaatactatgcagccataaaaaagaatgagatcatgtcttttgcagggacatggatggaactggaggctatcatccctagcaaattaattcaggaatagaaaaccaaaagcctcatgttctcacttacaagtggttgctaactgatgagaacacatggacatacagagaggaacaacacatactggggcctatcggagggtggaaggagggatagaaccaagaaaagtagctaatggatactaggtttaatgcctgagtgatgaaataatctgtacaacaaacccccattatctccatgttcatctatttaacaaacgtgcacatcctgcacatgcacccttgaacttaaaatgaaagttaaaaaatctataattatttcaaagttagaaatatatattcatttattaaacacaccaaaagtgagggagaaacaaaaatgttgttccaaagaaattctctctccaaggaatattattacataatttatatagcatcaatatggtttttattttaaaagatctcaagttgcccactagcaaaagggtggatttcaaatgttactatttaaaatacactggttcaatttcttcttacttttgcaatcagcttatattagaaaatttgtttaaacatcttagaagggaattgataatttttgctaatattttattttgttaaaataagtcataagaaatatttggcataaacacccatgcagaaatgacataatttttaagttaaatgatattaagttctctggagtggacttgttgctttagtgttgataattatggcataagtgttatgatccatggaggatatgttgcccataaaaggaacagttcgatataaaagtgttgactgaagaaatgccaagaatgtgatttcagtaatattctttgcataaggtttctcattgaaaatgcatgagacctgcagctttatttattcctctgaggaaaacttcagacagagcagtaattgcagaggaagagtacactggtcgccttggaacctggagggaattttcaccctcaaagttcatcaacagctttctcaaatttctagctgtgggctaaacactgggaagccaagtaaataagctcagatgctatgggaaatgctgcaaactatttcctcaaatatttcaagtaagaaaaaatctttgttgtcaagaagagtccacgttggaacccaaggtgtacatatatttgtattcattaagaaggtgtcttaaaagatgacatgagatagaaatgtttatgtcagatgtttctgggatccacctttcaaccaaatggaatggttgtttcagtcttctaaaacattcaagcacacacttgggtgaagatttttcttatgcaatgccctcttgaggatgcttctcatttggcaaacggtaaccctgctaaagggtagtgctaagattttaaattgaattttatatattatatacaagaatgaaacagcataatacaagaatgaaacagcaataaagaatcttgttatttgttctttggttgacacgatgtctatttattttagatataaaagtatttgctgggggcggttccaagatggccaaagaggaacggctccagtctacagctcccagtgtgagcgacgcagaagacggatgatttctgcatttccaactgaggtaccgggttcatctcactagcacttgtcagacagtgggtgcaggacagtgggtgcagcccactgagcatgaactgaagcagggcgaggcatagcctcacccggcaagtgcaaggagtcagggaattccctttcctagccaagggaagctgtgacagacagcacctggaaaatcgggtcactcccaccctaatactgcacttttccaatggtcttagcaaacggcacaccaggagattatatcccgcacctggctcagggggtcccacgcccacagagccttgctcattgctagcacagcagtctgagatagaatcgcaaggtggcagtgaggctgggggaggggcgcccaccattgctgaggcttgagtaggtaaacaaagcagcctggaggctcgacctgcatggagcccctcgcagctcaaggaggcctgcctgcctctgtagactccacctctgggggcagggcatagctgaacaaaaggcagcagaaacctctgcagacttaaatgtccctgtctgacagctttgaagacagtagtggttctcccagcatggagtttgagatctgagaacagacagactgcctcctcaagtgggtccttgacccccaagtagcccaattgggaggcaccccccagtaggggcagactgacacctcacacggcagagtacccctctgagatgaagcttccagaggaatgatcaggcagcaacatttgctgttcaccaatattcgatgttctgcagccttcattgctgatacccaggcaaacagggtctggagtgaacctccagcaaactccaacagacatgcagctgagggtcctgactgttagaaggaaaactaacaaacagaaaggacattcacaccaaaaccccatctgtacgtcaccatcatcaaagaccaaaggtagataaaaccacaaaggtggggaaaaaaacagagcagaaaagctaaaaattctaaaaatcagagcacctctcctcctccaaaggaatgcagctcctcgccagcaccagaacaaagctggatggagaatgacttcgatgagttgagagaagaaggcttcagacgataaaacttctccaagctaaaggaggaagtgcaaatccaccgcaaagaagctaaaaaccttgaagaaatattagacgaatggctaactagaacaaccagtgtagagaagtccttaaatgacctgatggagctgaaaaccatggcacgagaactaagggacgaatgcacaagcttcagtagccaattcgatcaactggaagaaagggtatctgtgactgaagatcaaattaatgaaatgaagtgagaagagaagtttagagaaagaaaagtaaaaagaaatgaacaaagcctccaagaaatatgggactatgtgaaaagaccaaatctacatctgattggtgtacctgaaagtgacggagagaatacaaccaagttggaaaacactctgcaggatattatccaggagaacttccccaacctagcaaggcaggccaacattcaaattcaggaaatacagagaatgccacaaagatacgagaagagcaactccaagacaaataattgtcagattcaccaaagttgaaatgaaggaaaaaaatggtaagggcagccagagagaaaggtcgggttacccacaaagagaagcccaccagactaacagcgaatctctcggcagaaactctacaagccagaagacagtgaaggcccatattcaacattcttaaagaaagaattttcaacccagaatttcatatccagccaaactaagcttcataagtgaaggagaaataaaatactttacagacaagcaaatgctgagagattatgtcaccaccaggcctgccctacaagagatcctgaaagaagcactaaacatggaaaggaacgaccggtaccagccattgcaaaaacatgccacattgtaaagaccgtcaaggctaggaagaaactgcatcaactaatgagcaaaataaccagctaacatcataatgacaggacgaaattcacatataacaatattaaccttaaatgtaaatgggctaaatgctccaattaaaagacacagactggcaaattggataaaaagtcaagacccatcagtgtgctatattcaggacccattaatgtgctgtgttccattcaagacccatcagtgtgctgtattcaggagacccatctcacatgcagagacacacaggctcaaaataaagggatagaggaagatctaccaagcaaatagaaaacaaaaaaaggcaggagttgcaatcctagtctctgataaaacagactttaaaccaacaaagatcaaaagagacaaagaaggccattacataatggtaaagggatcaattcaacaagaagagctaactatcctaaatatatatgcacccaatacaggagcatccagattcataaagcaagtccttagagacctacaaagagacctagactcccaaacaataataatgggagactttaacatcccactgtcaacattagacagatcaacgagacagaaagttaaccatgatatccaggaattgaactcagctctgcaccaagcggacctaatagacatctacagaactctccaacccaaatcaacagaatatacattcttctcagcaccacatcacacttattccaaaattgacaacatagttggaagtaaagctctcctcagcaaatgtaaaagaacagaaattataacaaactgtctctcggaccacagtgcaatcaaactagaactcaggattaagaaactcattcaaaaccgctcaactacatggaaatggaacaacctgctcctgaatgactactgggtacacagcgaaatgaaggcagaaataaagatgtcctttaaaaccaatgagaacaaagacacaacatgccaaaacctctgggacacatttaaagcagtgtgtagagggaaatttatagcactaaatgcccacaagagaaagcaggaaagttctaaaattgacaccctaacatcacaattaaaagaactagaaaagcaagagcaaacacattcaaaagctagcagaaggcaagaaataactaagatcagagcagaactgaaggagatagagacacaaaaaacccttcagaaaaaccatgaatccaggagctggtttttgaaaagatcaagaaaattgatagagcactagcaagactgataaagaagaaaagagagaagaatgaaatagacacaataaaaaatggtaaaggggatatcaccaccgatcccacagaaatacagactaccatcagagaatactataaacacctctatgcaaataaactagaaaatgtagaagaaatggataaattcctggacacatacaccctcccaagaataaaccaggaggaagctgaatccctgaatagaccaataacaggctctgaagttgaggcaataattaatagcttaccaaccaaaaaaagtacaggaccagatggattccacaactgaattctaccagaggtagaaggaggagctggtaccattccttctgaaactattccaatcaatagataaagagggaatcctacctaactcattttatgaggccagcatcatcctgataccaaagtctggcagagacacaacaaaaagagaattttagaccaatatccctgatgaacatcgatgcaaaaatcttcaataaaatactggcaaaccgaatgcagcagcacatctaaaaggttatccaccatgatcaagtgggcttcatccctgggatgcaaggctggttcaacatatgcaaatcaataaatgtaatccagaatataaacagaaccaaaggcaaaaatcacatgattatctcaatagatgcagaaaaggcctttgacaaaattcaacaccccttcatgctaaaaactctcaataaattaagtactgatgggacgtatttcaaaataataagagctacttaagacaaacccacagtcaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattacaaaaagaggaagtcaaattgtccctgttggtagatgacatgactgtatatttagaaaaacccatcgtctcagcccaaaatcttcttaagctgataagcaacttcagcaaagtctcaggatgcaaaatcaatgtgcaaaaatcacaagcattcttatacaccaataacagacaaacagagagccaaatcatgagtgaactcccattcacaattgcttcaaagagaataaaatacctaggaatccaatttacaagggctgtgaaggacctcttcaaggagaattaaaaaccactgctcaacgaaataaaagaggatacaaacaaatggaagaacattccatgctcatggataggaagaatcaatattgtgtaaatggccatactgcccaaggtaacttattgattcaatgccatccccatcaagctaccaatgactttcttcaaaaaattgggaaaaaaactactttaaagttcatatggggccaaaaaagagcctgcattgccaagtcaagcctaagccgaaagaacaaagctggaggcatcacgttacctgacttcaaactacactacaaagctacagtaaccaaaacagcatgatactggcaccaaaacagagatatagaccaatggaacagaacagagccctcagaaataataccacacatctacaaccatctgatctttgacaaacttgacaaaaacaagaattggggaaaggattccctatttaataaacggtgctaggaaaactggctagtcatatgtagaaagctgaaactggatcccttccttacaccttatacaaaaattataagatagactaaagacttaaatgttagacctaaaaccataaaaaccctagaagaagacctaggcaataccattcaggatataggaatgggcaaggacttcatgactaaaacaccaaaagcaatggcaacaaaagccacaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaaagagctcaaacaaatttacaagaaaaaaacaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccacttagaatggcgatcattaaaaagtcaggaaacaacaggtgctggagagtatgtggagaaataggaacacttttacactgttggtgggactgtaaactagttcaaccattgtggaagacagtgtggtgattcctcaagcatctagaattagaaataacatttgagccagccatcccattattgggtatatactcaaaggattataaatcatgcagctataaaaacacacgcacacttatgtttattgtgtcactattcacaatagcaaagacttggaaacaacccaaacgtccatcaatgatagactggattaagaaaatgtggcacatatacaccatggaatactatgcagccataaaaaagatgaattcatgtcctttgtagggacatggatgaagctggaaaccatctttcttagaaaactatcgcaaggacaaaaaaacaaacaccacatgttctcactcataggtgggaattgaacaatgagaatacttggtcacagaaaggggaacatcacacaccagggcctgtcgtggggtgggggagggaggaaggatagcattggaagatatacctaatgtaaatgatgagttaatgggtgcagcacaccaacatggcacatgtatacatatgtaacaaacctgcacgttgtgcacatgtaccctagaacttgtataataaaaagaaaaaatattatttaataaaataaaaagaaaagtataataaaaaaagaaaaaaaaagtatttgcttacagcagtccttcccattattttgctaaaatatgacaggattattcatgttcattatttagtcacagtgtagggagtttcttttaaagttacaacataacttgaagtggacaaatcctaagtgtacacaaattttaagtcattttttaaaaaatatatatgcacccgtataaccagccggattcaaatatagacaatttctcagaaggctccttttgcctcatcttagtcaacccagaggttctagctattctgatttctatcactacagagcaggtcttcttgttcttgaaagtcacataaatgaggttgcatactgtgtagtcttttgtgtcttggttcttttactcaccattctgttaatgtgattgctaagtgttgtaagtgggagttgattctttttaaatttcaggctatatttcattttatggttatactacaatttatttatccattctactcttcatgacatttgggttgttaccagttttaggctaataaaataaatgtcagctaaaaattaaaagctgggaggaacattcttgaagcatcttatgcactgatttggcttgagtgtacaccatatattggaatttctgggtaatagaataagcacatacttcactacagttgctgccaaaagttttcctggatgcttctattattattctctcattccatcaacaggtgatgtttcagttgtcccacatctttggcaaaatttgattttatcatttagccattggtgggtaagtcgacatatctgactgttttgctttttgcacttgtgttttttcttattgtagttttaatatgcattttcccatgagtatcctcattatgcacattttcctaagctttttgatcagatgaatagcctgttttgtgaggtgcccagtaaagagtttccccctttttctatgttaagagttcttcttatactcttgacatgagttctttttttggggatatgcactgcaaataccttctcgccatctgtggcttgccttttcactctaagtagtatcttttattgtaattgttttgttggtaatttgtttcctggttttttttttagctttagaacttccagaaaaaaaatgagtttgatatattcagattgcttctagaaggatttatgttaatcacaaatctgtattttggaattctaaatactctgaaactttaagaaattttaagcaatatctcatttagttattataaaaaagaatagcaaaactttaaggttcctttagcactgtaactttatattgataacttaaatatcactgtataaagtccaatttcgtgaaacctctaattcagctccattttacattatgattattctaaacagtatatttctgaaaagttttaagcatggtagctatacatataatttccaccattacacaaatgaatcatagagtaatcttaacaaaatagagctgctgttacattgctaaatttctacactccaacacaccctatatttttagactatacagagcatataagatcttccttctaagaacttagacattcaaaagacatccctacctggagatttctatattgactttagaaacaaataaatatatggaagcaaatctataccacatgacacctcatctcctagagaacatcctattaaaaagtgctccaaatatcccattttttctttccaattcagtagcttgggttctttataatcaaaacagcagttggtatgtttagggagtttttttgaggtaaagataattctaagaatgaatgtaataaaaagaagagtcaacatctattgagttcttgctgggttttaggtattgtctaaatgttttacaaatattaatttattttaccctcacaataatcctatgtcttaggtagtattactgccccattttgtagatgttatatagtctgccagtaaccacatgcttgcaagaggaggaactatggtatcccagggcagcctggcttgctactttgggattttgatggattctgagaagccaccttaacctttgcacaaatctagaatcaccacaaatcttgaaggtttagatattaaccaacaatttgtttttttgagttatatatgtttgcaaagacagacatggacatttgttgattgtcaggtggcaactgaaggctatacattggcttttaaaaatccgaatggtttttaaaaatctgaatctgaatccctttatacatagcatgtacatttctattcgtcacagtttttaaaacaccgtctgtatttaacatctctactttctacaattaggctgactggcttcttaaagcaatagaatttgagatctttggacactaaaccaaggaactgcaagaaaagaaagggagaccggtatttgttcttgtctactgggggattcatgtcttacatcacaggggacagtgtcaacaaaatgaaaattttctttgtggcttgtcaatgactgccctttataccttcctttcaaagaaatgtttctatttgtttcctcaacggtatctctggatctccctacacagcccccaaaataacatttgtaatttattttgattacaaattagggatgtagaaagaggatgggaacctgatttattaagcccccattttgagctaggtagttcgcatattatatctcacttatttattcctgggggaaaaacaacgtaacaataaacttaaattttgttttatttcttcaacatatgcagaagaagaaagtggtgcttagagagaggaaaagtattgccaaggctacagagctagaatatgtgtagagaaaactaactgtgctcatttcaccccacagtggggcctccctgttatctggataaaagtcatgaaagcttagcacgtagaattaaaccacagctttatattttgcaatagtgtatatttcaaaatgaaaaaaaagagtcacttttagcattttacagcttctttaatctaaaattttgcccattggagactaatacctattttttttgcttaaatgtatttcttagacaatttacattttaaaccagcttgaatgccatattttacacacatacgtatttttatggcagatcatttaatagcaatacgtttactgttgtgggattatttaaacatacatggttctagttaaggtatattttaaaaatcttgcattttattgcatatgattcaatttttgctgtgcaaagataactgctttaatgatggtcaaatattttttgaaaactaagaaaagcaatgtttattttgcatacaaaaataactttatcttcaattatatacattcatttatatgtcaggtaaataagaagcatttcctctgtgcctcaccagaaaattagtgtaaaaggtaaatatggaagaaaacaaatgagatcttgaggcataactaaatgattcagcattatattggtaaataagcatcctggttaatatgaacttatttcctctaataattccgtgacatagtcacaaatgttttaagagacaactggagtcttggtagctggagctatacaacaattaatttaaaaaatgtaaacatggagcctaaggacacttaataaaggtgttaatgggctttgggtggctgtcctaaacccattgaaattatatgcaaataggtgaatactgtgtttgtgtgttatgtgaaacagatggcagcttttcttagattttttaaagggtccactggtctaaatgtagtataatgaccacaatgatgatattcactaatatttattaaatgctttgtgctttctcatgtaattataacaacaacccaatgaaacacaggttgagaatgtcttatgtgaaatgcttgagaccagaaatgtggcagattcttgatttttctcattttagaatatttgcatatcccaaatgagaaatcttggggatgggattcaactctgaacatgagattcatttatgtttcatatatacttcaaacatacagcctgaaggtaattttacacaatattttaaaataatttgtagatgaaataaacttttgattgcaacctgtcccacgaagtcaagtgtggaatttttcacttgtggcatcctgtcagtgctcaaaaagtttcagatattagagtatttagaagtttggattttcagattaggaatgctcaacctgcagttacattattaacccaattttatagataaaccaaatgagtctcaaaatggttgtcatttgacaaaaatcacagcatgtaggaagtgaaacctactactactaagaggtatgcagtctgttccttgagcaaccttgtctgatataatagttcctaattgcatggggttttcaggcacttgaaacacggctagtgtgagggaggaactgagtttttaatttatttaacgttaacccatttaagcttaaagttaaaaactgatacagttccgtttttagaaaatggtaaattatgcttgaagacacttggacaggtggatatacttcttcaattgtaaactgtatgaaatctacatacaggttaagcatttctgagaaaaattcagcatccaaatcaagatgtgatgcaagtattaaaatatacaccagattgtgaagacttgataaaaaaatgaatataaactatctcacgaatgatgttcttatattgattgtgtgttgaaatcataacattttggatatatttagttaacaaatttattacacttaattttacttttttatttcttagtataactactagacaatttaaattatataattcctattacatcttcactggacagtaagcactgctgtagaacaatcatgatatcatatagaagggaatgaaaaataaaatggtagaatgcctttctagattttttaaaaacctttattaatttagaaagaattcaacaagacaaacatagagtaaaatttttcttttttttcattttttatcattattatactttaagttttacagtacatatgcacaacgtgcaggtttgttacttatgtatacatgtgccatgttgctgtgctgcacccattaactcgtcatttagcattaggtatatctcctaatgctatccctcccccatcccccaaccccacgacaggcccggtgtgtgatgttccccttcctgtgtctctgtgttctcattgttcagttcctacctatgagtgagaacatgtggtgtttggttttttgtccttgtgatagattgctgagaatggtttccagcttcatccatgtccctacaaaggacatgaactcatcatttttatagctgcatagtattccatggtgtatatgtgctacattttcttaatccagtctatcattgttggacatttgggttggttccaagtctttgctattgtgaatagtgccgcaataaacatacgtgtgcatgtgtctttatagctgcatgatttataatcctttgggtatatacccagtaatgggatggctgggtcaaatggtatttctagttctagatccctgaggaatcgccacaccaacttccatgatggttgggatctaattaaactaaagagcttctgcacagcaaaagaaaccacaatctgagtgaagaggcaacctacagaatgggagaaaatttttgcaatctactcatctgacaaagggctaatatccagaatctacaatgaactcaaacaaatttacaagaaaaaaacaaccccatcaaaaagtgggtgaaagatatgaagagacacttctcaaaagaagacatttatgcagccaaaaaacacatgaaaaaatgctcatcatcactggccatcagagaaatgcaaatcaaaaccacaatgagataccatctcacaccagttagaatgacgatcattaaaagtcaggaaacaacagctgctggagaggatgtggagaaataggaacacttttacactgttggtgggactgtaaactagttcaacctaaagtaagatttttcaatatttatttataacttgaagagacaggtgaaaaagaagatgaaattccacagactaataaaacatggcttggtttgacacttggaaaaataagatttgaatgctaagacttccaagaagaataaatcaatatctggaaatggctagctagccaaagttaattttgagaaatgtcactgaaaagctctgggaaagttatctgcaattataatctctacgctgactacacgaaatttgtgaaaaaaaattttttaaagttaaaataagaatcaaggaaaattaaaataaataaacaaaataaaacatcattatcttgtgatacagtgccccaagcttctactcctttggagcagtccttagtgcccaaggaaatgacagctcagaaatgaagtgtttaacacagaacttggtgcatagaaggtgcccaggtgggaagaagtttgtaggtacaatgtaggaccaatctggagcaggaacagaatgtactcaggattattacaaggccgttgcccccattatggctctgaggtagacaaggagaaaaaaattgcttcactgacctgccaaagatgacatttgcatctctgttattatttagaggaagacagcacctctgcggactcatttatggtattttttctaaattagccaggttccaattcagattcacataactctttagggaatataactcaaaatctctgtcattaataaaacactccaagtcataagcagtcaggtgtggaaaccaagtctcctagattaacaagtatctggaaacctacatctaattgagaaagaaagctacatatgtatatattcaatacatgatgattgtaaataataaaataaatgtgggttttgatcaaagtcaacaaataaaacatataactcataataaagctactctattgatatgataaatttggagggcaaattataaattacacatacattccattattaaaaaagaaaacacatgagggcaatttaaaaaatatattcttttccgtcagcatttccaatggacttatattaatctggtggtttgtcttctaaattgcaagatggttcactgcatatatgagaaaatcagcccatactagcagatcttaatgaattaaaaaatcttttgaacattcattcaagggttgactagtaagttcagcacctgcttcaatgtcttaattttaaaggatttcccatgatttctctgtctctagtaggaaggatttacacagatttatatttgcactataatctgtcttattttttaaagagatcttatggtgcaactcctgaataataagagtgtcaaaaatgatgtattaaattacaggggtaaaaaatacttatttttattatttatattttgggagttgaagttacatgtaaaaaaaaaggagggctgatgaattgacataagatgccttaatttaagttttatttaactcccctttcattaagattaatcaagcattttctaaattaccaaactgtatttttaaagtatttgaaaacaaaaggaccacgcattttccttaaaaaaattacatatacatttatatatcacattgcatgcctgtactaaaacatctcatgtaccccataaatacatacacctactacatacccacataaatttttaaaaaataaacaactgaaaatgtatatctttattgtcatcatcttcatgaaagaaatttatatatgtattcccttcaaataatctccagttcaccttaacgtagttgtaaccataatgtatattcaatatttgtttcctttttctacacttgtaccacaaaatatttcccaaattgtgacataacccacattgccattctttttagtggccacaaaatgtttcatcttatgttaattatagttatattaagaaaaataggcaggaagagaaatagactgcaatagcctcttaaataatggcaaactttagcatttttcactattacttgcttacaaaccaagttatttctttaactgctaaattaatagatttcaagttataagtcaaaggtaattagcctaaaataaaaaattattactaagtggcttaaattatatcttgtaaaagatcagagcaagatgaattttgagatgtacaaattaaaagattttaatgttttctgtagttacagttctggtatgcatttaatttggccctgaggtatttaatcacatagaaactttacaatacacatgcaaatgaagtttgaaattaattttgtcttagcatagtcccactgctttgccttactagaacatagggacatactgttctgttaaggtaccatgcagaatgacagcagataatgcaaaactctcttagtgttcacttccatttgattataaagggaaaaatatagaagcagacaaaaattaaaattaaaaatactaaaattaaggaattgtatattgacaggaagagtgttcattagagaatttgtatctctgctttactatgtggtatcaggtgctcaaagcagtcatttgatttttgtaaggtccagcacaatttagctccagtcgtccatctgtagcaaggtgtaagaatgatttgcccaataggagttaagtctatttgaggtgataaaaaagcgattgatttttaagtggcataaacaatgtccagaagtatgctgaaactaaacaaatgtccagaagtatgctgaactaaaaaatattattaagagaatatcaccgatagtagagtacatctgaagacttaattctgtgagaaaatgacttggagaatttggtaaaaacttttttcaaaattttattatagaatccacataaattaattttcattattaacaaatcagcaacagacacaattcaaacataacaatatatgtatatgcacatgaggacctaaggaaatcaagtcaggtcctaaaatcaggcaagagtactaagataaattaaacattcttttatctctcactttagttagatttttatgggacattacatgtgttagcatttgttatgggttgagttgtgtctcccaaaaaaatttatatgttgaagcaactgtacctgagaatgtatttagatagagggtatttgaagaggtaattaagttaaaattaattaactagggtgggccataatccaatctgactggctgactggcgtccttttataagaagaggaaatttggacacacagaaaagacatctggggtgaacaagcacagagaaaaggaagccctctgcaaatcaaggagagaagcctcagaagaaactagacctgccaatacctcgatctcagacttccagtctccagaactgtgaaaaaatacatttcttttgtttaagccacccagtttgtggtattttgtcatggcgtccctaaaaaactaatacagcaagttaggctggtcaaaatgtgacaagaagaatgaagttgccccttctgaagatctgccaagatgtatcagtacagtagtcccctgtcctctgtggggagtatgtcgatgcctgaaatctcagacagtgctgaacccatttgctgtcaatcagaacacatttctgttcatgtattccacacacaaattgaatgcctttttcatcttaactaagcacttatcatgattgtggctgtaactgtcgcagtttgcggtgccacagcaaaactagcatttttttttttcttcacaatttcatgaatagaagattagttcttacagaagatcttagcaatctcagcatataatttttttctctcatattacatagagaactttcaccttttcacttgaagcattttatggctctctggcatatacgaatgaccagcatcactactgatgtgctttggggaaacttaattacctcttcaaatatcctgtatctaaatacaagctgaggtagtggggcttcaacatttatttggagaagtcagataaggtggcttgaaaacaagcataatgatacagcaacagtttacctgataaccaagatgactatgaagtgactcaagcattgtggctccactgggcaaaagaggattcacgtcccaaaggagatttcatcccactatttagaatggtgcacaatttcaaacttatgagttgtgtatttctggatttttccatttaatattttcagaccagagttattctctagtaacgaactgaaactgtggaaagggaaaccacagataaaggcaggactactctaccactgctctgaaagtgaactgtggcagaagcactatacacaatttagttaataagcgatattagcatctactttgcatagatgtggaacacagtctacacacttcaagaccttctgagtttttcagtttgggaaacaattaatttaaacaatatttagtgttgtggaggaaggatattttgttttaaatgtattgtatgtgaagcatctttgacattgagataaaagtgggaggcagataggagtggttttggagattaggaaaatagattcaagattgggtgccattttctaagactattttcaaaaaactgtttaaatatatgtaacaatattaatagtttgaccattcataagtatacaatttgtcagtacattcactatgtaatatcctcactatctatacctaagcctttttcatcatccccaacaaaaactttgtaaccattaaagaactgccactttcctccccttccccagcccctggtaacctctgttctactttctgtgtctgtcaatttgcatatcctagggacctcttataaatggaattacacaatattagcatagagtcaatttttgaagtcttagagataaacaatgtcactcagagaaagagtggtggtgtagggagtgggggataatattaggaaaaatcaaggaaaaggcacaggagtctggatctctcttattacaataatacaatctgctccactcccctttctgtctccttgattcagtggaagtaagaaaacttttaatgaacatattgtacataagagatggtgcctgagaagtttatgaaacaaatgatcatagaataaattatttttgcaatgactcatatacatttatagatatggggaataggtattttggaatcttttttaaattaacactatttatgtcccactgtagaaccttagggaaaattatttaaattttcatatttccaccagaatctaaaattcagagatacctgtcatccagcaagaattgggattgaaataataacaaagaggtactgtgacttatggcttagaaggttcttatacacaaatcattttatttaaccttacaaccatgaaagactggtattattattttaattttacagaataagttggggcagtcaaggagattccagataggagagcaaagaccatcttctttccaattacatatatagattttcaattagagattttactttggaaaaattttaggtttacgaaaaaaatgcacaataatatagagtgtgtccatgtgccccttacacaattttctcaaaggtttaattcttatattactatgagacatttttcacactaagaaatcaacattgctgaattactattaaactccagactttgtatttgattagttttccacttgtgcttttgtatgttccaagatccaaaccatgatgccatgctgcatttggcatacataaatatttggggagttattaaatactggagtttacactgttgtgctttaagaaattgagcttggtcaaatacaaggaaggaaattgtggatatatcaacagtttgttggaacattaaaccttatttttgtatgacaaataaaacttaactaaataaacgcacaagacaccatcatatatatacatatgatgtacatatatacatatatatataatggcaagatgattttacatatatatgttttctgtagttacagaaaacatttcatgtatatgtgtatatatatgtaaaatcatcttgccattcctagaaaaaattaaaaatgcagcattagaaaaaaggaaactaagtttaaatgactcatcaataatttttaatagacaaacaataatgtatcatgtcacttgtttccttttctttttcagtgagatagctttgcaagaaattcttattactcaatacaatgttttatagattgtttcataagtatcaaatatgcttctttggtattgatgtttcttgtcctactaatgcatactcattcatttaaaaaaattttcaaatatatttttacctcaaataatgtatatattggaaattttatctttctcaaaagtatgggttgcttaatattgagataatttctaatgggtaaaatttaccaggaagccacttgcaaaaactttaaaaatgttattttatatgcctttgtatctgtcttactttaaccactttttgttttccttgaaatatataatttagatgatagaatttcagtttaagatatatgtcaaatatttctacttttcttcattagtttttgagatataattcttagccttctctagattttcctgcatattatctttggcattgaacaggtagacatggctcacatttacatcaggtaaagtgtagaattcaacttaggagatgacaacatttaaatatattaatatcagtattaagagttcttagggcagtaatcattgtaaaaataatattattgaacagttatttcacactgggttcttaagtgttttacttatcataaagcataatttaatacaccaacacagcttcctagggaacagacactaggctagtcacttctctataaaatacacttattttccctaatttacaattataaataaacattataggtatataaatcctgtgtataaccgtaacaggagaagtagttttaaaatatcaaatttaagtcatcaaatatttcagtggctttatctaatattgtttatttcattttagacttattaatattttacttcacgtaatcaacatgtatatattaaatcatcactctgaattcaactcaagagctcagatctttctaatatttgtagttttctgtcactcttgaacacaaaggttatattgtttatatgcctatgtatctcaacacacctgctcataatcgcactaagtaatttatttgatgattgcaatgacagcaaaaccaaactacccaaacacgtgatatgctgttctacataaagtcgatttttaaaaatcaatatcatcattatcatcatcaaaatcactaccaccaccatcagcactgtcaccaccatcatcatcagtaattcattgagttgacatacattatcttactctatattctgccaaggcaagcttcaaaatcaaatgatattagatatcttaataatttccataatttaacaatgtgaagctctagctatataagtcaactggggggatattttaaacaacagaaaattggtttatataagctagacaaatgtagtatacatatgttctttaatggttctgattttaaactctggaaaacagtattgtctttttaaaatttctatttagctcagtgtagagcctggatgctaaatagaagctttacctagcacaggcatctttctaatcttttcttaaaatttttttgtgggtacatagtagttgtatatatttatggggtacatgagatattttggtacagtaatgcagatacttttgtatgagtagtaatcacatcatggaaagttgggtatccatcctcaaggatttatccttcatgttacaaacaatccaattatactcttttagttatttttaaatgtacggtgaagttattgttcactatagtcaccttgctgtgctgttaaatactagatcttattcattctttctatttttttttttcgtacccattaaccatcctcaccttcccccaactaaacttctcagcctctggtaaccatccttctactctctatctccatgagttcaattgttttgattttcagatgccagaaataagtgaaaacatttttttctaactatcatttttgtacccagtaagcatccccacctccccattaccctcccactatctttcccagcctctggtaaccatttttctactccctaccttcaatgagttcaattgttttcatttttagattccacaaaaaagtgagaatatgtgaggtttgtctttttgtgtctggcttatttcacttagcagagtgacctcctgttccatccacgttgttgcaaataacaggatctcatttttttttatggctgaaaagtaattcattttgtataagtatcacattttccttttccattcatatgttgatggacacttcagttgtttccaaattttggctgttgtgaacagtgctgcaacaaacatggaagtgcagatatctctctgatatctcatttcctttcttttgggtatatacccagcagtgggattgctggatcatatggtagctcaatttttagctttttgaggaagctccaaactgttttccatagtggtcgtactaatttacattcccaccaacagtgtacaagggttcccttttctccacatccttgcaagcatttgttattgcctgtcttttggatataagtattttaacttgggtagatgatatctcactgtagttttgatttgcgtttctctgatgaccaatgatgatgaacatcttttcatatgcccgtttgccatttgtatgtcttcttctgagaaatgtctattcaaatcttttgagtattttttatttggattattagacttttttcctatagagttgtttgagctccatataaattctggttattaatcccttattagatgggtgtgttgcaaatattttctcctattctgtggattgtctttttactttgttgtttcttttaacgtccagaagctttttaacttgatgtgattccatttgtccatttttgctttcgttacctgtgcttgtagggtattgctcaagaaattttttctcagaccaatgtctgagagagtttcctcaatgatttcttgtagtagctttatagtttgatgccctggatttaagcctataatacattttgatttgatttttgtatatggctagagataggggtctagtttcattcttctgcatatggatacccagtttttccagcaccatttattgaagagactatctattccccagtatattttcttgacatctctgtcaaacatgaaccttcaaagtgtttgttatagtggttgcactaattacattcccaccaaacgtgtacaagggttcccttttctctacatccttgccatcatttgttattgcctgacttttagataaaagccattttaagtagggcaagatggtatctaatcttaattacgttaatgcatgatgccattgactgtattgacttcttagtaataatcagggcttcttgagttcggtttccaattatcttcataattttagtttgagttctattacttacctcttttctccaagatcacttaaaatagtcatggttattataactatagaaataaggcatggtttattataacaataaaaacaagcttatattttagttgtatttgcacatatataaaactataacttaagccattgtagaagaaaaagttatttattctctagtttattttccctttttgaaccaaatgagaagctgaaaaagcaactagattttggaaatacaggcatgttttctgtctgttttccctgtgttctttacatcttgtatcctctttgtctactgaaattccacatgtgcttccaaatttagtgcaaactctttccactgaggacttttcagtctattccaggccatggtgaacacacttttttttttctcaacagtgttagtaggtacagtcttcttttctccgctaattaactatatgtgacttcctacatttctagtatcctcattttacttttttcttatacttttttcccatgtgttcatgtcttgtttctccaagaatatagtaagtacttcctttgagactgaaaaatcacatcttacaatttactttccctgtcaagcctggatcaatgtctcacacacattaagcaatcaataatttttgtttgttttatagaatgcagagatgcatggacaacgctctaggccaaaagagtgacacacaatatgctcggcactgtggccaaatcagatcctttacataattttgctaatcttttgttatttatgcctgttacatgaatatcttaaaatttataagatgctggtatagcttcacagtatgattatggccattttagttaactttaaacacatttttagaaggcatttaaaaaatcaacaagtgtgtagtttagaaaagatgattcagaattacactaaataaatatacatacaaattatgttttcttgcataactatctattcgacaaattaaaggtcagcaggatgggattacactctcagcctaattcatgctctgtgaaaatgaaatatactgacattctatattctactgggacacatgatctgtacctattttaagcccatggctcttcacaatccattgtttaaaaatagatcagttctgaactttggagacaggctcagaagggcattaacctctttcttgacagttaagtttgccattttgctctaatcaaatcagtataagtctgctcatgttaaaaatagacattcttgctttgtacacattccaacaggcactcataaacagaaggttctacctagttctattaggttctactaatgaatctaattagtttttatttttaaatatactgccagcatttatagaagtatacatgagtcttatgattctaacatttcaatatcaaattttgatgctaaggcaatgtctccaggaaactggctgataaaatgaagggaaagcttactagcagattgtttgaatacattccaaaagaaatggggcatatgatattgctgggtttggtgtccctcctgagtactggcctgataccctttgaatcaccctttcagcacttgcaaataactacatacaattagttatttaaatgtttgtcactccctaaaatataacagctgtaagagctctatcctatttttcactgcattgtagtaacattaagagttaaattctactgtgtacttactatgtgccaggcacttttctgcatttttatgtgttttgctcacttaatctttacaactctgtgaagcagttatgatcattattcacatttcaagatgagaaaaatgaagtacacataagttaagaaaatagctcagagttgaacatctagttagtagcggagctggatttaaatgaggcttgtggaaggagggccatctggtaatcgtgatgtgaaatagcccctcagtagtaggttctcatccattatgtgttatatagctgaaaaattgcgtatacttattaatggtggtacagaaaatcacaaaaaggatttaaactatcccaaacaatgaagctttggatatttctcagcagccaggggcaaataagagcatgttaagtggatgggaggagaatcaaggaggagggctctccagggaaagccaggtcaggcagcaactgagagggaggggaggatactagggattactgaagccaactttgcagactcatacatttgactagacacagccagagcgcaaccagagagtacagattagagataatgaatataccacacagtaatagttttaatttaaaatgctatgttttggggtaacatcttaagaattttcctcagaaaactgtaatgttcctttactatctgacccaagtattttagtgcacagtggaatgataattttttaagatgactttacaatcacttcccagaaggctgacaattccagtggagctcagtgtgcaggacgtacagcctagcttgaggatgaacaacacacaactgttatctgccactgtgaatcttctataccttgaagtgtctcaatatttaggtttggacaggggaacttgaacaattgtttgatgagtcattgacataatctaggtagaaccggtgtagcaatggttttatccaatttgggctgctacacaaaagtatcacagactgggtggcttatgaataaaaaaaaattatttctcacagttctggtttggaggttgggaaatctaagatcaaggtgctggcagactttgtctagtgaggggccacttcctggttcatagacagtgagctttttgctgtgttctcctcatatggcagaagggatcagagatcactctgggacttcttttataaaagcactgatcccattcatgagggctccaccctcatggcctaatcacctcccaaaggccccttcctcttaacctcctaatatcatcaccttggggattaggatttcaacatatgaactgggggcagagggcataaatactcaccttagtagcaatataaaagaaaaaccaacatattttctatctattccatgaatgtgattgggttatagtgattgattagacagaacatttgtataccctctataatggtaccttcctcttcgccccaccatctttaccccatcctccaagtgagctctgcattgaatgactaatgcataaacacggagaacttttaaaagtttttaaagttataaagtatttttcttcttaaagttaaaaagaaactattttttcacataaaaataggatgttatgtcatacagtgcatataccaaacataatcacagaggaatctaaagatgccagcatgcttttgtaatacattaaaaatacatggaccatagtataactgacagtgatactaagaaagttctgtggacagaagactttgttttgagcatcacttttcttatccatataagcacaagcactactgttctcttggcaaaatgctgtctctaagctttaacactcagtcactctgagatgatttgccaagtaggtaatccttatttattgtgtacttattaattttttccacgaagtaattacaaaatatgtactatctgagggttggagtcatagaggaagttaagaaagatagtccttgcttttccagatcctgagttcatatagcagaacagggaatgaacaaataaatattaagggcaaataagacaatataataatatgcatacaacaaaaacactgatgtgattgatggagaatgactgagagggaactaatttggatgagcttctcagggaaggcctcttcaggagataacatttgtattgagatttgaacaataagaatgggctagttatctgctaaaggtgtttcaacaatttgtctctaacacacaaaaaaagataaatcacctaatttttgccacaaaagtgaaaataggagaatgctttcaataaagtagtgtttttgaaatatcagctaactgaattaattttatatgcatggtatgaggtttttgtaagaggtttcaaagttctcacaaatgtagttcttaccgccattttacatcttcgggcttcacagtattaaaacacattgaaaggagagtctgaactataaaatggataaaacatagtacagacttaactgataatgaatatagactaattttaactttctttaccactgcattttacattctttctctacttttaggcaaaagtcatttgtataagtttgtgagacaatgaaggtatgacctattcctcacttttataagtttctgaattcccagacttgtgttaaatcactgctcttaactatatattaatgcctcaaattatgcaatactttcataagctttcttatttaatgaagtattttaggttgaaatcatactataagataacatgttgttgacataaaattgaatttatgatgagcaattctaatcatgtatattagatgtgtgtatacacattttaatatttttatcttttgtcacaaaatacatatcaaataattgaactttgcctttctggatatcctagttcactcatttagcatttatttgtcattcaatgtcttctatgtgccaggcactttctagacactaagaacataacagtgacccaaacacacctttgcctaagttgattcctcctctcccaagtgaaacacagcttttgaaaggtgaattgatatattttactgctttttagacattttttgtaatctatcactgtgacttgaatgtagtaggtacataatactccaatttgatgttatatttctcatcgttcttactaaacttttcttcaaaaatcaggtctgggtttttagactcagtgtcattttagtaataacttgttatctttctgccatacgtttctttactttcttattctactcatgctttttcccttcaaataaactgttaacttatgtatagcattaaacttagacctttgtgtgattctgatattagaaaagcaaaagctgaagagtagggaagcacatggagaaaccctgttttcacctttacaaggtgttaactggctgagcatttcatgcttccacttctaggatctctcattttattaagcagtcatgattcttagtatgattttcattcacgactctgttaaagaagaccttttactcagtaaatatttcatgacttcctactgcatgctggttactagaaatacaaggatattaagcacagctcctatccccaagaagctcatagtctttaaagagataataaactaacaaatgataaatgctgtgagagagacagagtagtgacagaaaatttatgaatgaggttaggtaacttataaatggtaaaaatgcttacaggaaagtagaaggtaagctgagtagaaaggaatgaagatacggtagcatgaagaaaggcaaaaaggccatcaatagcatttattttccaggaaattgtcaataatactctatagatgaagcattaatgtgaagaaaggaagactaaggcaggccatgaagagcctctgtgtcatatgaaggagtttgggtgttttccctgaagggaataagaggtcatgagcaggttctaagaagaaagttacattgtcaaatttgggttttatatcaatcaatatggtagctctgtaatggaatgcattttagctaattgacattcaagccagggagaaaagttgtgacagatgttgaggtaatgttgagaacctgaatatggcatttaaatatataaagaaaaaatattagtcacaatttagcaattgaatgattgtaggaattgaggaaataaaaggtttgtcagaggatgcacgtaaaagtgaaaagtggatattttttccagtgaagatcagtgtaaattatggtgtggcaggaggaagaatagtttttaatttatgtatgtatttatttattttttgagacagagttttgctcttgttgcccaggctggagtgcaatggcatgatcttggcccactgcaaccagtgcctcccaggttcaagtgattctcctgcctcaggctccctagtagctgggattacaggtgcccaccaccactcccagctaatttttttgtacttttagtaaagactgggtttcactatgttggtcaggctggtctcgaactcctgacctcaggcaacccacctgcatcaacctcccaaagtactgggattacaggcatgagccaccatgtccggctgggaagaatagttaataaaacacatgacacagaaaatgttcttgttatcttcattatatattaccttgagaattttctgcctagaagaatacttcccatttaagggtacacattactagggttcatttttattctcagttgtgctgttgtctttctgcagtctttcaatgagattttattctggaatcctaacttctccatgccttcttagaatatatgcttcaatttatcttgtctttctgtcttttgatttgatatttattcctgatactgtctgttggattacctttgtctccttgctatgatctgtctcactctactttgaacctctccaggcccctgagaatccaatctggttccagtgtcctgaaattctgcttttcttgtgaagaagttttagatttaaaaagcaaaatatgttgatagagtttttttttttaaacaactgataccagggtcttcaaaaagcttatggaaggtgcatattatgaaaaagctatatatgaatttcctattttctttatcaaaataaacttgtagaaacttcttacaacacatctgaataggatctagtttaaggcactaagaagaatgagacatcagttttaaaatagcctctctcagagcgatatgaattataaaattgaagcaggagcaaacatccaattcatgctgaagcttggatggaagaatgagctatccatctataaactgctaattcatttggggcatcatttccataaagttttagtaaaaaatcctttttgcattccctcaatgagattttaactagataacatttccttaacttcttggaatatatccttcattctatcttatctttctgtctttttatttgatctttattcctgatactgttttgtaaagaatgcttcacagaaactttatggaaacaatgtcctaaatgaatcagccgttcacagatggatcactcattttaagaaggaatgagacaatgttgaagatgaagcccataacagcagatcatctgcatcaatttgcaaggaaaaaattcaacctgtttttgccttatttgaaggagaccaatgattaatagcggaaacaataaccaacatcgtagacatcacaattgctcagctttcacaattctgactcaaaaattaaacttaagcaaactttccactccattagtaccaaaaccattgcagccagatcagctgcagataagagtggagctttcaatggaagttttaaacaaatgtgataaatatcctgaagcatttcttcaaagaattttaactggagataaaacatggctttgcaagtatgatcttgaagacaaaacatgataaaaataatggctgccaagagatggaagtggtccagtcaaagcaaaagcagactggttaagcgcaaaggtggctcatgcctgtagtctctgttactcaggaggttgaactgggaggatcacttgagcctgggaggtaaaggctgcagtgagctatagtttcaccactgcactccagcctggatgacagtgagaacctgtctcaaggaaaaataacatctgcttattatgagaatattttcagagagttagctaaagctttagcagagaaacacccagggaagcttcagcagagtcttccaccactacaacactcccactcactctgctcatcaaacaagggcaattttgtgagagttttgatgggagatcattaggcatctaccttatcatctcaatttggctctgtttgacttatttttgtttcctaatattaaaaaaatctgtaaagggcacccatttttcttcagtgaataatgtgaaccagattgcgttgacatggttaaattcccaggaccctcaattctttagggatgaacaacatggctcgtatcattgcttagaaaagggtcttgaacttgatagaggttatggagcttatgtggagaaatgaagtgaatatttttacatttatcttttaattccattttctatgatctttttgaaatcttttcatatatttctttcctttttttttttttgagatggagttttgctctgtcactgaggcagcagtgcagtggatctcaactcactgcaacctctgactcccaggttcaagcaattcccctgccttagcctcccaactagctgggattacaggtgcatgccactacacctggctattttttttttttttgtattttttattagagatggagtttgccatgttggccaaactggtcttaaactcctgaccacaggtgatccacctgcctcggccacccaaaatgctgggattataggcaggtgtgagccactgctcccagcttatttctttcttttaacaaaatataaaaaattgaagtatatttccaaaagcaaaaatagttatacattctaatttgattgagaaatttgtagggaaaataaactaaccaatagcagatatttagcctcatatttttaaaactcttaactggtatcttatggctattcaaaaaatataaaaaacttttagtgggtacagaaatttagataagtttataaatggtgaagatattagttggaatacaaatacttgtttttaaacttatagtaaacatactaggaattttaacaaaatttgaaaacatagacgaaatgttccttgcacataggggactttcaagacaaaagtggagaaaacaaatatgaaaaaataataataacatgggtagaatggataagtagcactcttatattacggactaagtacactgagggccagagaaaggagatataagatccagtctcatagctgatcaaataagataaatagaaataaataggtattatttgaattcaattttcccaagagaggagagacatttctggaacacatgtggtaaaggtgagaaatcataactgattttttcaaaacagcaagttgcacaattttgttgtaggccactttgcaacagacatgacagtgggggaaaggaaagctggagatttagctgtagtcagagtatagagggactggaagatgagcttagggagtctatacttgattcaatttataatgcaaagactgaaagtttctgagcagagaaatgactaacttatgtaaataaaagattaatttgaccgtggtattttaaatggtagtcagagaaatcagaccaaatgctggaaggcaaactaagggaacagtgaaaatagtctatgtgagatgctttagtttaggacaatggcagtgggaaaggaagcaaaggcatgaatgtaagatgtattactaaagttaattgatagcatttgatgattggatgtacagagcacagaaagaaaagctgcaaaatagggctaaagttttacattccaaataacttgtgagaatgactaaagaatgtacagagagactttaagagataaaatggtttaatgatggaagaaaaatgacttcattatataatctactacatgtgtgggtgcaggggatatcatttagctttagaggaaatgaactttaaggcaggaacttagaactacagtttatagaattgaaatgtgagataatataaataaaagataataaattcaaagatacagaatgaaaatccaatggctcagaaatgttgcagtgttaaagaagccaaaaaaaaattaaaaataaaaaaaatatatatattgggagagattcaggaactgtgttttgttaacagcataaaaagtggtcccagcatcttagaaaaattatcaataattaacaggtgtattagtatattataatgctgttaataaagacataactgagaccgagtaatttataaacaaaagagctttatttgactcacagttcagcatggtaggggaggcctcaggaaacttacacttatggtaaaaggggaagcaaacatgtccttcttcacaagatggcagcaaggagaagtgatgagcaaaaggggaagaagctccttttaataccatcagatcttgggagaactcactcactatcacaagaatagcagcatgcgggtaactgccccatgattcaattacctcctaccaggtacctcccatgacatgtagggattatgggagctacaattcaagatgagatttgggtgggaacagagccaaaccatatcattccacccctgccccctaccaaatctcatgtcctcacatttccaaaccaataattccttcccaacagtcccccaaagtcttaattcatttcagcattaactcaaaagtcaacagtgcaaagtctcatctgaatcaaggaaagtctcttctgtctatgagcctgcaaactcaaaagcacattacttacttcctagatacaatgagggtataggcatcaggtaaatacagctattctaaatgggagaaattggccaaaatgaagaggtaaaggcctcatgcaaatccaaaataagcagggcagtcaaatcttaaagctccaaaatgacctcctttgactccatgtctcacatccagggcatgctgatgcaagaggtgggctcgcatggccttgggcagctctatccctgtggttttgcagggtacagcccatctaccagctgctttcatgggtggggattcattgagtatctgcagtttttccagttgcagggtgcaagatgttggtggatcaaccattctggggtctggaggatggtggtcctcttctcacagctccactaggcagtgacccagtggagactccctgtgggggttctgacctcacatttccctaccacactgccctagcagaggttctccatgagggccctgtccctgcagcaaacttctgcctggacatccacgcatttccatacatcctctgaaatctaggtggaggttaccaaacctcagttcttgacttttgtgacccccacaggctcaacatcatgtggaagatcccaaggcttggggcttgcaccctctgaagccacagcctgagctgtaccttggccccttttatcaatggctgaaacaactgggatgcagggcaccaagtccctaggctgcacacagcaggcagcctgtgggcccagctcatgaaactattttttccccctagacctccaggtctgtgatgggaggggctaatgggaaggtctctgacatgccctggagatattttctccattatcctggtgattaacatccaacgccttgtcactgatgtaaattgctgcagaaggcttgaatttctccccagaaagtgggctttttcttttctactacatggtcacgctgcaaaatatttcaaagttttatgctctgtcaacttttgaacactttgctgcttagaactttttttccactagataccctaaattatttctctcaacttcaaagttccacaaagatctctatggcaggggcaaaatgccaccagtctctttgctaaagcataacaagagtcacctttgctccagttcctaacaagatcctcatctccatctgagaccatctcagcctgggctttattgaccatagcactttcagcattttggtcaaagccattcaacaagtctctaggaagttccaaactttcccacattttactctcttcttctgaaccctccaaacggtttcaatctctgcctgttacccagttccaaagtcacttccacaatttcaggtatctttgaagcagtgcccaactactctgtaccagtttactgaaatagcctgttctcatgctgctaataaagacatactcgaaaatgagttattcataaaggaaagaggtttatttgactcatagttcagcatggctggggaggcctcaagaaacttacaagcatggcagaaggggaagcaaacacgtccttctttgcttggtggcagaaagaagaagtatcgaccaaaagggataaaagcaccttttaaaatcatcagatctcgtgagaacttactcactagcaagaacagagcatgtggtaaccatccccatgattcaattacctcccacggggtccctcccatgatatgtgggaaatgtagaagctacagttcaacatgacaggtcattgacaactttcaaatgaaaaactttggtaaagaagctaagaccaaaccataattcattgagtacatagaaaccttttgagaagattggcagtaaaagaaaggagagggcaaagaagtgtaagaaatatgaataatggttggcagccaagatggctgaataggaacagctctggtctacagctcccagcgtgagtgacacagaagatgggtgatttctgcatttccatctgaggtaccgggttcatctcactagggagtaccagacagtgggcacaggacagtaggtgcagtgcaccatgagcgagctgaagcagggcgaggcactacctcactcaggaagcgcaaggggtcagggagttccctttcctagtcaaagaaaggggtgacagatggcacctggaaaatcgggtcactcccaccctaatactgcgcttttctgatgggcttaaaaaccggcacaccaggagattatatcctgcacctggcttggagggtcctacatccatggagtctcactgattgctagcacagcaatctgagatcaaactgcaaggcagcagcgaggctgcgggaggggcaccctccatggcccaggcttgcttaggtaaacaaagcagccgggaagcttgaactgggtggagcccaccacagctcaaggaggcctgcctgcctctgtaggctccacctctgggggcagggcacagacaaacaaaaagacagcagtaacctctgcagacttaaatgtccctgtctgactgctttgaagagagcagtggttctcccagcacgcagctggagatctgagaacaggcagactgcctccccaagtgggtccctgacccctgatccccgaacagcctaactgggaggcacctcccagtaggggcagactgacacctcacagggctggctacttctctgacacaaaaactccagaggaacgatcagacagcagaatttgtggttcacgaaaatctgctgttctgcagccaccgctgctgatacccaggcaaacaaggtctggaatggacctctagcaaactccaacagacctgcagctgagggtcctgtctgttagaaggaaaactaacaaacacaaaggacatccacaccaaaaacccatctgtacatcaccatcgtcaaagaacaaaagtcgataaaaccacaaagatggggaaaaaacagcagaaaaactggaaactctaaaaagcagagcacctctcctcctccaaaggaacgcagttggtcaccagcaacggaacaaagctggatggagaatgactttgatgagttgagagaagaaggcttcagacgatcaaactactccgagctacaggaggaaattcaaaccaaaggcaaagaagttgaaaactttgaaaaaaatttagacgaatgtataactagaataaccaatatagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaagaaaaggaaacaaacaaagcctccaagaaatatgggattatatgaaaagaccaaatctacgtctgattggtgtacctgaaagtgacggggagaatggaaccaagttggaaaacactctgcaggatattatacaggagaacttccccaatctagcaaagcaggccaacattcagattcaggaaatacagagaacgccacaaagatactccttgagaagagcaactccaagacacataattgtcagattcaccaaagttgaaatgaaggaaaaaatgttcagggcagccagagagaaaggtcggattacccacaaagggaagcccatcagactaacagcagatctctcagcagaaactctacaagccagaagagagtggggggccagtattcaaagttcttaaagaaaagaattttcaacccagaatttcatatccagccaagctaagcttcataagtgaaggagaaataaaatactttacagacaagcaaatgctgagagattttgtcaccagcaggcctgccctaaaagagctcctgaaggaagcactaaacatggaaaggaacgaccggtaccagccactgaaaaatcacaccaaattgcaaaggccatcaaggctaggaagaaactgcatcaactaacaagcaaaataaccagctaacatcataatgacaggatcaaattcacacataacgatattaactttaaatgtaaatggactaaatgctccaattaaaagacacagactggcatattggataaagagtcaagacccatcagtgtgctgtattcaggaaacccatctcatgtgcagagacacacataacataggctcaaaataaaaggatggaggaagatctaccaagcaaatggaaaacaaaaaaaaggcaagggttgcaatcctagtctctgataaaacagacgttaaaccaacaaagatcaaaagagacaaagaaggccattacataatggtaaagggatcaattcaacaagaagagctaactatcctaaatatatatgcatccaatacaggagcacccagattcataaagcaagttctgagtgacctacaaagagacttagactcccacacaataataaagggaaactttaacaccccactgtcaacattagacagattaacgagacagaaagttaacaatgatacccaggaattgaactcagctctgcagcaagcggacctaatagacatctacagaactctccaccccaaatcaatagaatatacatttttttcagcaccacaccacacctcttccaaaattgaccacatacttggaagtaaagctctcctcagcaaatgtaaaagaacagaaattataacaaactgtctctcagaccacagtgcaatcaaactagaactcaggattaagaaactcactcaaagccactcaactacatggaaactgaacaacctgctcctgaatgactactgggtacataacgaaatgaaggcagaaataaagatgttctttgaaaccaatgagaacaaagacacaacataacagaatctctgggacacattcaaagtagtgtgtagagggaaattcatagcactaaatgcccacaagagaaagcaggaaagatccaaatttgacaccctaacatcacaattaaaagaactagaaaagcaagagcaaatacattcaaaatctagcagaaggcaagaaataactaaaatcagagcagaactgaaggaaatagagacacaaaaaacccttcaaaaaattaaagaatgcaggagctggttttttgaaaggatcaacaaaattgatagaccgctagcaagacgaataaagtagaaaagagaaaagaatgaaatagatgcaacaaaaaatgataaaggggatatcaccaccgatcccacagaaatacaaactgcccacagagaatactacaaacacctctacgcaaactgactagaaaatctagaagaaatggaaagatttctcgacacatacaccctcccaagactaaaccaggaagaagttgaatctctgaatagaccagtaacaggctctgaaattgtggcaataatcaatagcttaccaaccaaaaagagtccaggaccagatggattcacagccgaattccaccagaggtacaaggaggaactggtaccattccttctgaaactattccaatcaatagaaaaagagggaatcctccctaattcattttgtgaggacagcatcatcctgataccaaagctgggcagacacacaaccaaaaaaaagaattttagaccaatatccttgatgaacattgatgcaaaaagcctcaataaaatactggcaaaccgaatccagcagcacatctaaaaggttatccaccgcgatcaagtgggcttcatccctgggatgcaaggctggttcaatatatacaaatcaataaatgtaatccagcaaataaacagaaccaaagacaaaaactacatgattatctcaatagatgcagaaaaggcctttgacaaaattcaacaactcttcatgctaaaaactctcaataaattaggtattgatggggcgtatctcaaaataataagagctatctatgacaaacccacagccaatatcatactgagtgggcaaaaactggaagcattccctttgaaaactgccacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctgggaatccaacttacaagggacgtgaaggacctcttcaaggagaactacaaaccactgctcaatgaagtaaaagaggatacaaacaaatggaagaacatttcatgctcatgggtaggaagaatcaatatcgtgaaaatggccatactgcccaaggtaatttatagattcaatgccatccccatcaagctaccaatgactgtcttcacagaattggaaaaaactactttaaaatacatatggaaccaaaaaagagcccgcatcaccaagtcaatcctaagccaaaagaacaaagctggaggcatcacgctacctgacttcaaactatactacaagtctacagtaaccaaaacagcatggtactgataccaaaacagagatatagatcaatggaacagaacagagccttcagaaataatgccgcatatctacaactatctgatctttgacaaacctgagaaaaacaagcaatggggaaaggattccctatttaataaatggtgctgggaaaagtggctagccatatgtagaaagctgaaactggatccctttcttacaccttatacaaaaatcaattcaagatggattaaagatttaaacgttagacctaaaaccataaaaaccctagaagaaaacctagacattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttataagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagacaccatctcacaccagttagaatggcgatcattaaaaagtcaggaaacaacaggtactggagaggatgtggagaaataggaacacttttacactgttggcgggactgtaaactagttcaaacattgtgaaagtcagtgtggcgattcctcagggatctagaactagaaataccatttgacccagccatcccattactgggtaatacccaaaggactataaatcatgctgccataaagacagatgcacacgtatgtttattgcggcactattcccaatagcaaagacttggaaccaacccaaatgtccaacaaggatagactggattaagaaaatgtggcacatatacaccatggaatactatgcagccataaaaatgatgagttcatgtcctttgtagggacatggatgaaattggaaatcatcattctcagtaaactatcggaaggacaaaaaatcgaacaccgcatgttctcactcataggtgggaattgaacaatgagaacacatggacacaggaaggggaacatcacactctggggagtgttgtgcagtggggggagggggagggatagcattaggagatatacctaatgctaaatgacgagttaatgggtgcagcacaccagcatcgcacatgtatacatatgtaagtaacgtgcgcattgtgcacatgtaccctaaaacttaaagtataataataataaaataaaataaagaaatatgaataaccaagagcaagttattttggtccaggagtgatctgaatattctagtgggaagaaggcagatttctagggaggaacagaaagatgatgcaaagcaaagaggtggttattaatgttgcaaagtgtttgaatgagataataggaaatgaactgctcacagcaagtcattgtcttatcagggtccatgagatgatccaggaaagtgaagatgggaggaagaataggaatcaaaaagaagaatcagtttgataagaatgagggggagaaaaatggggacaatatagacaatgaggccacaagaaggaattttaaagagccagaaatacagacaagagaacagttctgaggatcataaatagaacaattttccaatacttttttcaacatttaagagcttatgtaggtgagaagctaaagaagataaggacaaaatatcttaataagtttaggtttttctttagagtaacgtggactagaagattctccatgaagagagaaaataaacaatgattatgtattatgcatactgaggacaataaatcttacctctctcagaggatcattgagttcattgagaatattttcctcatcaaagattttgccttggtatctgtgttcatagtaatcatgtatcttctgacgcatatcagctggtaacttatggaatgacatgtattgttccacttgcttatactgtaaggaagggaaaataaaattaaaaaaaaacattgttagggtgtatcagaaatcatattattttgttttgctatattcaataatatttgaatactcagttacaaaaaaaaagaaatcctttaagatgaaggaactaatttacctgggtctaatgtacctattttgtgttacataatgtataaggcattttatttaggtgcacatttcatggaaagaactaagatatcgtggagaggaggcatgaagggagttaagagtgaatttaagggagtagctacagaaaagccagtgatggggcaaaaacaaaatgttatgctatttttttaaattgagttctaaaagaagtatgaaattgtttggctgtcgatttttaagaaaaatctcatacctatggatagtacaataggttttatcttaggctttttggcaaaagatcagaatctaattaaatttggaatcgacaggcagggagcttggcaggtatttgcagatcattcatacttcaacaacacagatgccctgtaaattactgagaactaagagactatggcaggcttccaatttaggatttaggagaatatcacggtgagactagatccacattactgtatagctgaaagttaacttagacactgaagttcatttaaacaagtaggcgtcaactgtgattgttttaagaactggggagggcattgcttttttggaaggctgatcttcaggcttaattcccgagattgattctattgacctatctgcctatttatatttatacacacatgcgcgtgcacacacacacacccagagagagagagagagattgtttgtaagtagcatccctgcatccctgatagtcaaacaggaccatataagcatggatattacctgggtgcctattagaagagaataatttcaagcctcatccaagacctatggaataagaatttgcatcttaaaaacgtctccagatgactcacgtgcatagatatacaccttaaagtttgagaaacaatccctaggtgtttcaaatgcagggggtcataagaccacacactgaaaaaaaaataattaggtcttaaaaattttgtttcattgtatagatgacagcatcgagtacaaattttaatagttggtaacacaactggataaagatgtcaaaataatatttttcctcatgtaacacacatttgatatactttatatggacaagattttctgaaatattttcttgataacacagctctgactagatctagatctcctgactctttgcccataattattgtaattgtacttggtaattgataatagacctagctaatgagaaacagcaacccattttattgcatctcttcattttttccaacatactttcattttgcaaaaaaattatattgtttgaacattcccttttgaacattagtaccctcaaaggaaataccactttgtcgtgagactttctttgataaccagactgtccatcaaactatttaaagcctgaaggcctatgtacatctctctgaagtaacttgcttgctcaaacactacttggaggggtgagaatctgaaaccttaactgacacattgagatcttcatttctactttcttttccatgcatctcagaaatatgaagagcagcactgaaacttagtagtattttattcatttttgggaaattagtgcttgtatgcaaagacctactaatctagggaaaatataatctgctctatctctgtctctgaatttggaaaattaatccctttgtagctaagaacaaatgttacatgtatagttattttatttttatgaagcttagggttgattgaatctaattgtttttcctcacacaagtcatttaacccttccagatctcatttatgaatcaacaataagagagtatttgactaaatgatcttccttttactttcaaactaaaattttaaagttatatgactatttcttatcatttattcatattgtttgaagtttgaatctatattactattttaagcattcattgactcatagtaactattgatctagcaaacattaaatgattattgtatgccagtagttctcaaggtgtggttgccaaaccaccaatagcacttgggaattctttataaatacacattcacagtctccactccagacctactgaatcagaaactctacatttgggacacagcagtatgtgttttaacaggtccttcatacacaaaaatttcataatcgctgctatatgccaagtactgtgtcatcttaggacataaggaagcatgcttgagtgagcgtgggggaaacaaagtaaatttagttttcagcaagttaagtttaagatgcccatagcacatcctaatgcctctatgtaggtcaggcactcagagaagaaaatatatacatcattggtgactaagaagtcactaagggaggatgtgtcaaatgaggcgaaaaggctaaaaagtggaacttatgttttaaaatcagctgagccaggagactgattaattaagggtactgttaatacctgccaagatgtgagagcagaaccagaaaaacatgattagaaaatccaaagaaggattaaatttcacagggggtgtggtcaaaaggaatctattctaagaaaacaggtactgaacagtggccagtgaatttggaaattaggtagtaatctctgttagaatacaacacactaaaaacaggagctttttctttttctttttgtctgtttctcccacacctaacaagacttgcaagaatgtatgaaaatatcacttccatgtgatgtgaataaaaataaccaactattctttgaaaaagacacttagtagtggtagtcagaccgtgaaacaaactagatgttacaagtaatgtgtaagttggcaaagtcaaaaaatgataaaatggcaaactttctaatagttgtagtaatatactatatgcaaaatatgacttagtatatttagtagtcacagacaaatagatttttgaaaagcaaggatgccaatacaattctttggaaacataagatcaaaagtttattccatcagatctaaagagactataaaataattatcacttaaaattctaatatatttttatttttaaaagtttctgtataattataaaaatttataaaagtatgcatgtacatgattattaaaaatgagatctaacaagagtgtttataaaacacggcaaggatccagtttcaaacccaccagtctcacttttccatgttaaaaggtgtttaatccatatcactaagcaatatgcttgttcccgtttcttatatagataattacaggcattgtttataaactaactgtcataaaatggtgttttgccacttacagtaccccaaatcttcctttctcatgctatagctgtgtcactagtgttaattcttaccttagttgctttgtacctttatgcaccatgtttactattatttcttgttcagataactctaagatactttaccaggtgaaagtaaaaaaactccctcgttcactttcatttgatgacttctgtcatctctaatgttacaatgtaaaggtagattataactttgttcctataattggaacttccaaactcatagtgttaacattactctggccatgtaaatatttaccacaaagccaaatggtgtgagtatttgatgacatttcctttcttgctcatcagtagattaacaagacttgttcatccaatggatttgttaatcctgcaattgctgatcacatttatttcttgggtaattagccttcatttagtattattttttttctagcctccttatcccaccagatagacattgagttttttcttcaaagattttcctatagaatttctctttacaacatccttggtttggctcagtatttctaaatgccatgtttctgttttggtttatttattcatgttgctggaaaaaatccccaagtaaacgactaagaaagattgtatgttttctgaatctttccatgtctgaaattgtctttattaaactctcaaagttgactccatatagaattctaggttgaactcctctagttggatgttgaggctttggatctgaatttgattctctatgctggatttgatttgtttcttatctttatttaatgtatttagtctctgcattttctcctacctttctctgcattccctacattttctctatatttccccaacatttcccctacattctagaatattttctgaaattcttagaaaacattaattccgcctccttttcgttgatcatttatttctgtacttttaatatttttagtttaaaaatatactaatatgagatttttgaaaatgatttttaggccgcttttattctccaaaatatgtgacatgtctaaatgtgaattcaaaattaccctctagatttagtttcagtaatgtctttggtgacctttccctatgtgtgtatgttaggagtagggatcatgttacaaagcagactgtaatgatttgtgctatggtttggataggattctccaaacttcatgttgagattttatccccagtgttgtaggtgggacctattggaaagtgttcgggtcataggggtggatccctcaaggacaaagattatgccctccctcaggcgtgagtgaattctcactctgttagttccctagagagcttgatgataaaaagattctggcacctctcccctctctctctccctcttgcttcctttctcaccataaggtctgtgcatactcctgctccccttcactttctgccatgagtggaagcagcctgaggccctcaccaatactgatgcccaaacttgaactttccagccatcagaattgtgagccaaataacctttcttctttattaattacccgatcttaggttttcctttttagcaacagaaaaatggactaagagagaagataatggaaaatagaagtggcaatggaaatcataagtataataaccatcacgagctgtctatgaggtgagaactgacgaataattgaagggaatagaaggcaatctaatagaagaatagtaagcaatctaaagaattttaaatcacatttatattgtttttatatccatgaaatgatacccttatttataaaactgaaacaccttagtttatcccctactccttcatcccaatccttaagacatcaccaaattatgtaagttttacctaccaaaagtttcaataattttccatttctctgcatcaccattctggtcaaagctactctctctccttcaactcatgaccagcttcttaactacattcactgtacctatttatacatgtcttcctccaactctaactcattttccatgattcagacagagacatctttttaaaatgttaatctaattgtcacccctaaaggaaactaaaaatatttcaccccaaatatacctctttgacatattttgagatggctgttcagagggcctgcagacaggaatagccctacaaaggtgccttttgtggggagatttgcatctgtggaggcaataaagtgaaataaataacagatgcaagcaagcttttcctgacgccccgcttgtccatgtctaggaaagattaacagagagtctgacaccttttaagatctgacagagaaacatttaccatagactatcacctattttttctgagggctgctacctgtacatctgcacaagattgcctttactccatgcctttcttcttctgctctaactctgacaatctgtcttgccatgccataagcccctattctttctgtaaccccaagatggtataaaagcatcaatgattgggcatttctttgagttttcatattttgtatgactcctgtacatacatgtgcagataataaatttgtatgcccttttttcctgttaatctattaccagtttgtgttatagagtcagattacaggtcttcaggaataattttatacacttcacattcctggaagacagggataagaagctgtccttcccattgtattagaggggcaaatcacataaattgaaaaatagcaaattattaataattactcatcaaatcagagggaactttaagttcatgattctatccccatgtctcaaatctataaaacactgcctataagaagttaactttttactttcaggaagcatcaaaaaaaaaaaaatatatatatatatatatcacctgatttataatatctcaagataattttatagtgtagtgcccacagtagagtcttacctgtggggtatctatgtgtacattggcatcaatacacatcaactactatttttgtgaaacaaaagttaatacttttttttaaaaggcaaaagactttttggtgagtgatggaactaatttccatgttcaaataaatcataaatgctacattaactagctatttgaaagtaggctacactagctgaaatagagcttctttaaactttatttctaggacaacctacagcatcagatgaaaggcatagaccttcatctgccaaaataaacatgcatgaaaatgtgttacaatttcaagggtgtttacacatatctgagtgtcaatttaaaaatatctgagtatcttaactgaccacattaagttttattggcattgtaaaactccatgagtgctggaaccagtggtgtcagtgtttaatctacactatattcttgacttttgactttgagtatatatatatatatatattttttttacctttcagtttttcagttttttatatgtcaatttgaaatgataatatctaacgtactgggtgccatgaaaattagtagtgatactgcatgtatgttatgtgataaataataaataataaatagtaattattagaaatatcattaaaaagcaaacaggttaaaaatccagttgaataaaaatatatgtctcattctcaatataaacacagcaatgctaaaatggtttctgaagaggtatttttcttatagaataaaaaagtataaattttatattccagtgactacatgtgttttaaatgtaatttgacaaataataataaataataagaaaatatttaaaattgtttgctcttcaaagaccaacaatcaactttctttttaacttttttatgtttaaataaataatcactgggcttatgactaatctatcttaatttttaccaagaaaaattctagtattgccagctatttacacagcaattgaagccataatttctctttattatcctacatttaaaaatacataaattcatatatatagaaaagctgggtaatatgctaattcatttaacaagtattgtttctagaatttttgcagcaagattgaactattttcaagaactatgctataaacacagcaacatcttcaatgcatatcttttagaatttttttttctcagtaaaaatgtgttgctggttattttatgaaaaagttttaagtcacatagtctttacatagtaagtcatataatcataaaaataacatgaaatcttcctgaatttgattttcaataaaatgaatgggaaaaaactaaaggaaaatcacaaatgagggaaagcagatggtttagagatttgtttgctttttagcagaagtttgagtcagatactcctattttatcttcattttatatttccttttttggaaagctgggtaacaaaacatagatttttctatggaataatgattatttagctctcaagatatgcaaaagcttttttgaaataaaatatgtatctactttgcatggaaaacagtcaaaattccaactgaatgtaattttattttattttattttatttgtttttctctgagatggagtttcactcttgttgcccaggctggagtgcaatggcatgatctcagctcactgcaacctctgcctccagggttctagcgattctcctgcctcagctgtagctgagattacaggcatgcatctccacgcccagctaattgtgtactttcagtagagatgggatttcaccatgttggtcagactggtcactgcaacctcggcctcctgggttctagtgattctcctgcctcagctgtagctgagattacaggcatgcaccaccacgcccagctaattgtgtactttcagtagagatgggatttcaccatgttggtcagactggtcactgcaacctcagcctcctgggttctagtgattctcctgcctcagctgtagctgggcttacaggcatgcaccaccatgcccagctaattttgtattttcagtagagatggggtttcaccacattggttagactggtcttgaattcctgacttcaggtgatccacctgccttggcctcccaaagtgctgggatattacaagtaaagcgtgttattcttccatccagaataatctcttccaatacaaatagtcatttgctttcttgcttatggaacttagctatccattcagatatttcacaagaaactatactttcatctatgtaaaaatgcaggattcaaaagaacttggaagttgtttacactacataggttttcatttatcaattattattattatgtttttattttataatggccaagttgagcattgtttttgaaaagtcaatttaacattgtttaagatttaactaagcatgtaattgaaaaaaagtgatgatgagactttagtgtatttagcaattagaagaaaatccttgattactaaacaagtaaattgtctgtctaaaacatctttagtatgttaatttatttgtaattatggaataagggtcaagggttagatgattggtagaagtagaaaaaatcattataaccattgtaatacagctaaatgtgtgcttgaatatttttaaaatcctttagttttcctgctctaaatgactttaaactttattactatagttttgcttggtgtgtgtgtttgtgtgtgtgtgtgtgtgtgtgtgtgtgtgtatctatctatgtgtagggaaatgatctggcccttaattgaacaagagtatggactgatataacatgcctaccatggttaactcaatcactcttccatttttttaaattggaccatttaaagcattttatgctgtctcaactttcctatttccttccctcaacagtttctttcactcacagaagatgactttacatagaatttcaaaaagaaatagaagcttttacttaagaatatctactaactcatttaaagagaaatctattttttctccttctgtctttatttctcttataaacaatgaaagaagtgtttctaattccatttaaagctactctttcacctgtatttgaatgtccagttacaataattaaaatcataatcatatctaacccttggatattaaatgctgttttcctggcactcaactaaaccttttactcatatttacctacttaatcctcataacaacagtgtgagattgctatcatgatcttcattttacagataatgaaattgaggcacagagaatttaaataacttgcataaagtcacacagctaattagtgctgaagccaggatttgaatctaggcaatatggcttcagactgtgctcttatttgctgcatgacattcttgtcatcaaaaaatgactctctattgatcacaagtagccctctacttaccatcctatttttcttctctcctttctcaaccagtttcttgaaagtgtggtctacttttgttatctaactttctacttctcattaaaaccttcaattatagcttccattccttctatttcactaataatactcttgcatttccattatttcctgattactaccatgatacttaattagatatttcacaaatataccaaatatatatatatacatatttgtgatctgaatatatataatatttacatattatatatataacatattatatatatatacatatatatatatatatatatatatctgaatagtactgaacaccagtggttaacactattgatgtcccatacaacgcgtctttccttgtaagctgacccacctctgacctcaactgtaccaatggtggaaagtccatctcagggtttttgcatcagggctctctgggaactctagaaaacttgctcagctcaacctagagttgcatggtcttctggggggtgaggagaggtgtaggttacaccacataaggcaacgttcaaccaatgagggacttgagtctccagattaataacagcccctatccttcagagaaacaagtataaggttcattctacacagttcctcagagagtgtcagtaggactaagccccaattgtctataactaaaaaaaacctcaataatatacccttcattagattttcctttttcatggtgatatggtttggctgtgtccacattcaaatctcaacttgaattatatctctcagaattcccatatgttgtgggagggacccagggggtggtaattaaatcatgggggccagtttttcctgtgctattcttgtgatagtgaataagtcttacgagatctgacgggtttatcaggggtttccgcttttgcttcctcctcattttcttttgctgtcgccaaataagaagtgcctttctcctcctgccatgattctgaagccttctcagccatgtggaactgtaagtccaattaaatctctttttcttcccagtctcgggtatgtctttatcagcagcgtaaaaatgggctaatacacgtggtcttactactcctgtttcctaatcctgattcttaaagttcttcctcagtaaattacccaccccaaattcttttattaggctctgctactaggagattccaaactaagacagtattacaaactgagcccttcctcctaagacatcttttcctgtgtcttctccatccacatatggttctggctttcgtgtttcttctttggctgctcttttcagtctcatttgttggcatcttttaatagttggtatttccaaagactatgcccaaggccgccttttcttttcaccttacgtattttccttggacaatccttcccactcacatgacttcagttactatcaatataccaccaatcctcaagtcaatggtccagcagagaacaaatccctgatctcgactcgtaagcctgttttccctttaaacatctacccttacaacatgtttcatgggcacatcaaacgcaaaattgaaattgtcttcctttttcctgcatgtcttcaagtcaatggtccagcagagaacaaatccctgatctcgactcgtaagcctgtcttccctttaaacatctacccttacaacatgtttcatgagcacatcaaacgcaaaattgaaattgtcttcctttttcctgcatgtcttctctatccaacctgcagcctaggctacagacttggttttgggtacactcatgtctctgtttccaacgtattttactttaaattttcacaaactaaccatcttgtcatttgggagttaatttttaatgccactttctctgagtaattttccctaatgcttgtcttaaatgttaatgtaaattaaaataatatgagaattttgttaacatgaagattcacattcagtatgtatggggttgaaactgaaattttagtatttctaacaagattctagatgatgctaatgctggtagtaagagaattacagtagttgagatttagattagattagatgagctatttattctcctataacatcaagtatttcccatgcattggctcttttcacactattataatttctactgaaattacctgtgttctttgcagaccataagcttcctgaaggtgttcaataattgattaattaatatgttctaaaatattatttattgtcaaacatattatttagtctttgtcaagaacaagctttgaagtcctttttaaaaataaaagtgccatttttttcatacgatcaaatatatgtaaatcatttaaactcttttacatatttttatttttatttttcatgttagatttagggaattcatgtgtttgtttgttatatgggtattacatgcataatggtggtgactgggcttctaatgtacccatcacgaaactattgaacatagtactcaataggtaatttttcaaccctcacccacctcccattctccacccttttggagtccccaaagactattatctctatctttatgtccatatgtacccattgttttgctcacatttataagtgagaacatatgatatttgattttctgcctctgaggtatttcacttagaataatggcctcaaactccactttgctgcaaaggacatgattaaattattttttatggctgtgtagtattccatacatatatacccacattttctttatccattcaactgttggtggatacttatgttggttccatgattttgtcattgcgaatagggctgtgataaatatatgagtgcaggtgtcttttttatacaattatttatttctttttgggtcaataccaagcagtgggattactgggttgaacggtagttctatttttagttctttgagaatctccatatcgttttacttattttttttaaaaaagacttctaatgatacagtagaaacaagcaagtcagacacctatttgttgtcataaaatacctacttttcttttcctcaaaggcaggtaatatgccttaagcagttgaaggatccataacttagtttattaaattttaacttaaatgacctcccatttaatttcttaaaattagatgattaaggacataatgtttcataaattataaagccaattagcataaatctagagatactatttcacaccagggctaaatctactaggctatcaaagattgcagcttttagagcaataatttagataagtttgggtgattaaaatgatgcaaatattttgaaaatgtgggtgcactgattgttgttacattatagcatttgtgtgtgtgtgtgtgtgtgtgtgtgtatgtgtgtacattctcttctttgtatgttatgtgtgtgtgtggtaattcttcaataaaaaaaggaaatttaattatgtttaacttccattccattgggaagatatattcactatctgcaataaacagttaagtgatttttaagaaataatatattcctaatgtcctttttccacagccccaacaaattttttaagcttttagtgatagatgataaattattatgtaagccctgtatatatatgaaaatgcgttaaaaacagtaatagcttaaaacaggacattgtttaaatatcactaatcttctacttcattattttagtcaaaatgtttcttagcattagtaatagcttgatttacatttgtaaatctctctagtttgtttgaaatgcaactgtttctatcttattgtttgtagctttccaaatttaaagcaactgaatatctgaggatatggataattactaagtgtaaatataatctgaagaataatttttaaatgactcaccagcaaattatcatgcagaagcaacatatctgatgaagaaaggagcatttataatgcttaacttttatctttgtatttgtttttcaaaagcgaaaaattctaacaaagatattccttcagtacaaattaaaaacctgattttctttacattcataatataaaacaagatcaaaatggatgttatcatggtacttatcaagtctgaatgatgtggtattaagaattaatgaagaagaatacataaatattaagaagatttagtcaacatctatgtttcagatccaagtattgattggttatcagtctcaacataaatcaatttgaatttttgtgctaatccaatgggggaagtgacaaaatataaacactataatgatcattagtaagtacctactaaagagtaaggagatgttattagaagaaagtgcaaagtgttgcacagcagaataagaaaaatcatagtccttgagtcttaagttaaaaatcgagtcttatttaagtaaaatccatattggtgaatatcaatgattgatttcaaaagaattacacacatatatgtatgtattttgtatacatacatgtcatattgtatacaaaagatccatattggtgaatatcaatgattgatttcaaaagaattacacacatatatgtatgtattttgtacacatacatgtcaacatacagaaatatgaatttctgaatgtaagactatatatgtaacataaattgaacaatactttgaattggcagtgagtttttagttacctgttgacactgctttgaatttgatagcaactcaggaaagtagcataaccatgatgcatgatgttaccagtggtaagaggacaatttcagaaaatcattaatggagtttataaaagaaaattgatccaaactttctcaacttggctagtatgaaactaatggtcactggttgatctaaatctaaaatttgactggcttttcagaaccaggtcaccatcgtaacttccaaataagtttcctgaagtagtgagagaagacaaagaacttccaatctaactacaataaagtcaaaactaccttattaaaattagaaccattcatcaatacaaaacaaaacaaagtttccaggtaaacttcacagcaataattgagagcagctgcttactaaaaatttagggacctaatacaaagccagtggtttcagataaaatgagggtgagtcaagataaatgtgttatcaggcaggaagtgaattggctgttatgggttatgcaaagtaaagaagtgaaatgcaagaaatggaccaataggttactggatcttgactgtagatgaggtgagaagagagcaaaacaaaggagtttccagttgtgttccactcaaaccataaaggaaccaggagcttacactattcctaacaatcaataagattttttgttaatttattctaatagaagaagagtagattctgtttcaattaatacacgttttgtgttctcacattataaacaatttctcaaaatcagctgaggctgcaagataatgacactaatttgatcttttcttctattttcgccatgctgaatgatcttaaggagacacatttaatccatagtcactgctaatgaacattttcttagtcaggtgtttaactaggcaatgagaaaattatagcaaaaacataattatttttcctaaagttaagatggtgggctaaggatgagttatatacatttaaatagaaatgataaataatggaataatttgatttggaaattattctagtgcactatttctcttctatatcaacattaattgatagagaatgttgttctctcccagttttatggctttagactctatatatactggtaagacctaaatatgtatttctaggctagactactccattaaatcaagattcatatactaaatggcctaattggcatctccacttgggtgtgtactgaagatttaacatttaacgcatccaaagctgaaatccttcatcaaaacctcatcttactagtgttctgcatatcagatgagtttctaccgggagctggggccaaaagtgtaaagtttttgttttgccatatttttttctctcatacaccgcttctgtcagcaaattttattagatgtactattttttccattacagtttcattgaagtataatttatataaaataacatccataaattaagtgaacattttcgtgagaaatcatcatcatgtggaggttttagaatgtttccatccgttccaaaagttccctcattcaccttcatagctaggtcatattccctcccctggtcccaggaaatcactgatctgttttgttgtcactcttattttccctgttctagatttttacataaatggaataacatttattctttttcatgtggcttttttttttcactgaggacaatgtttccaagatatattcatgttgttgcatatatccgtagatattttttctttatttctgaataatattcctggatctacttttataatgtatttacctgttcacttctattgctacaaacagcccagtttaccatgaatttgtatgtgtatgattgtgatagccttctaattggcttgtttccccttttgactgctcataattcattcttaactcagtatctcatattatccttctaaaatgtaaatctgcccatggcataactttgtttaaactttccaagtattccaatcttagatggaaagccaaaatatttcaataacctgtatgggcctatgaaacacagcctttcatggcctatcctattactgtccttgctcactcagccccagcctgattggtactctcaagcctggaaggagagtggggagcacaagagtaacagagaagtcaagaaatagatatattcgcatctgcctgcatcatcaatattcttcagtggtaagaaatttaaaactataatattagaataatacagattatagaaaatcctgtaaaaattgaacatttgacaagtgacattagtatataccccaaaacactccagtgcatgtatctaaatatcactgcattgtagttttacttggtaaaggagtgtgaacattattgacttaattgattattccggatcatgagcataaagaaatgtaattatagcgcaagctaaaataagatacctaagagataagagaacctctaggaataaataatgttagctctgtattttcttaaatcaagttttcaagtttgtaaataacaataacaaaaatagcaggaacaaaatatactgtgctataagacctgatgtatgactggaattgtacttccactggggttgaaataaaaaaaaaacctctcagttaattttttcttgggaaaaattataatggtatgagattcatattttctttgaaaatataatagcatatatatgttttcactgttaatggagtatgttaaactactgcaatgtgaagaatacaaggttgtttttgttcttcaaatagacataactttatataaaactacaattaccaaatttgattaaaaacggacatatttatccaatattatcaaattaaaacaagttaaaaaaacctgaatatataaagatgttaactgaaaaacttgatttataggtactccctattttcctgccttaaaaataatgtcccattacattaattttttttctatattaaagtagatattttagtgggtcagaaacattgggcatatattcaacatactgttataggtcatagtagaaaacagcacatatacaccttgtttcacagccttctgaacttcaacatcagagttttgaagaagagaaccttcctcattgctacctttataaattaaaaaatataaactaaatgtgtaaataatagaaactacatatttttattgatgttcaaagtttttatataattataaacaattctcccaagagataaatataatttatcatatatgtgtgtgcttatttattcttttccaaactataatgccataaggccacagagctagctattgtcatgcgccagcaataactagaaacattttcccctgattgtagaatggtattcttactcttcactgacacaaaatgcaaaaaaatgttaaagataaatattttttatgtgcacacactctaaaagaagtaatggcagtatagtgatgatggagctaaatggaacatttaaaaatgtaaattttaaaaattctttttactgattctccataaatatgtatatttcgaggagtttggtgattttatttgctaggataagcaaaggagaggagaaaaatatatcaaagctagagaaggaagaaaacattacagacgttgggacatatattgggtaaactgtggacaatgagaattttgaaaagcagtcttaagatacaacataccagaatctctgggactcagctaaggcagcgataagagggaagtttataacaccaaatgcccacattgaaaagttagaaatatctcaaattaataacctaaaatcacaactagaggaattagagaaacaagagcaaatcaaccccaaagctagcagacaggaaataaccaaaatcaaagctgaactgaagaaaactgaaatagtaaaaactgtacacaaggtcaatgaatcctggagttggttccttgaaaaaattaataacataagtcgatagaccaccagctagactaataaagaaataaagagaagatccaaataaaaattcaacaatgacaaaggggatattaccactgaacccactgaaatacaaaatcctggctgggcacggtgactcatgcctgtaatcccagcactttgggaagccgaggtggacagatcacgaggtcaggagtttgagaccatcctggacaacacagtgaaaccctgtctctattaaaaacataaaaattggctgggcttgggggcggtcgcctgtaatcccagctactcgtgaggctgaggcaggagaatcacttgaacccgggaggcgaaggttgcagtgagccaagatagcaccatttcactccagcctgggtgacagtgagagactccatctcaaaaaaaaaaatatatatatatatgtacacacacacatacacacacaaggtgtatatgtgctgttttctactatttatattatatataaaatatatataatatacattagtaatattatatatgaaataaatataatatacattatattataaaaaatatataatatacattatattatatataatatataatataatataattatatattatattatgtatattatatataatgtaatatatatagtatatatcatataatatatataatataattatatatatattatatatataatataattatattatatattatatataatataattatatatatattttatatataatataattatatattatatatataatataataatatattatataatatgttattatatataattatattataatataatacaattaatataatacatattatataatataatatatataatatatattatattttatatataatatatatttatatatatatttatatatataatatatatttcatatataatatataatatgtgaaatatatatgttatataatatatatcatatatattttacatattatatataaaacatatatattatataaatatgtaaattatataaaatataattatataaatatgtaaaataatatatacttatatataaaaatatataaaacatttacatataaaaatatataaaacatttacatataaaaatatataaaacatttacatataaaaatatataaaacatttacatataaaaatatataaaacatttacatataaaaatatataaaacatttacatataaaaatatataaaacattttatataaaaatatataaaacattttatataaaaatatataaaacatttatatataaaaatataaaatatttatatataaaaatatatacgtatttatatataaaaatatatacgtatttatataaaaatatatacgtattctatacacaaaaatatatacgtattctatacacaaaaatatttacgtattctatacacaaatatatgtacgtattctatacagaaaaatatgttcgtattctatacacaaaaatatgtacgtattctatacacaaaaatatgtacgtattctatacataaaaatatacacgtattttatacataaaaatatataagtattttatacataaaagatataaaataaataaaaaataatatataaaaataaaattatataaaatatatatattttacatatattaaatatataaaatataatatatataaaatatatgtagtatataatatataaaaatataatatatataaaatacatatagtatatcatatatataaaatatatagtatataatatatataaaaatatatgtactttataaaatatatgaaatatatgtattttatatattttatatatgttatatataatatatattttacattatatataatatatattttatattatatattatatatattttatattatatattatatatattttatatactatatataaaatatatatttcatatatttaatatataaaatatatatttataaatataatatatattttatataatatatgtaaatatatattatataaaatatattataatatatatccctcagatatacatcatctataatttatattatatacattatatacatcatctatcatatacaatatatacattatatacatcatctataatatatattacatacattatataggtcatctataatatatattacatacattatatacgtcatctataatatattacatacggtatatacgtcatctataatatattacatacggtatatacgtcatctataatatattacatacggtatatacgtcatctataatatattacatacggtatatacgtcatctataatatattacggtatatacgtcatctataatatattacatacggtatatacgtcatctataatatattacatacggtatatacgtcatctataatatattacatacggtatatacgtcatctataatatattacatacggtatatacgtcatctataatatattacatacggtatatatgtcatctataatatattacatacggtatatacatcatatatattacatacggtatatacatcatatataatatattacatacagtagatacataatatatataatatatattatatacataatatatattatatatattatatacataatatatattatatatattatatatataatatatataatatctattacatatatgtatataatatatattatatacataatatatataatatatattatatacatattatatataatatacattatatacataatatatattatatattatatacattatatacataacatatatattatgtacattatatacataacatatatattatgtacattatatacataacatatatattatatacattatatacattatatatattgtatacattatatacattatatacattatatacattatatatatataatatacatatccctcagagagatatatatatccctcagagactaccacgatgaagaaatgggtaaattcctgaacacatacaacctcccaagactgaatcaagaagaaatgtaatccttatacagaccaataatgagtttcaaaattcaatcagtaataaaatcctgccaaccacaaaaagcccaggaccagatggattcacagctgaactctaccacatttataaagaagtgctggtagcatttctacttaaactattccaaaaacttggggagggactccttcctaactcattctatgaggccagcatcatcctgataccaaaacccggcagagacaacaaaaaaagaaaacttcaggtaaatatgcttgatgaacacagatacaaaactcctcaacaaaatacttgcaaaatactatgaatatatatatatatgtgtgtatatatatatatataaaaccatatatatgtagatagatagatatctttttcttcaagtgattttgtaaaacttatttttggttcatgggtatatatatagagagagacagagagagagagagagaactatactatagttcatggaaagttgaactatactatagtttgtcgacagcagtgtgggatttctctaagaacttaaaacaggatcaccatttgactctggaatcctattattcagtatatactcaaaggaatggaattttatatatatatataatatattatatataattatatataatataatattttataatatataatatattatatataatatattttataatatataatgtattatatataatatattttataatatataatgtattatatataatataatattttataatatataatataatattttataatatataatatattatacataatataatattttataatatataatatattatacataatatatttcatgatatacaatatatataatataatattttatgatatacaatatatataatataatattttatgatatacaatatatataatataatattttatgatacatattatatataagatcatattttatgatacatattatatataagatcatattttatgatacatatgatatataagatcatattttatgatacatattatatataagatcatattttatgatacatattatatataagatcatattttatgatacatattatatataagatcatattttatgatacatattatatataagatcatattttatgatacatattatatataagatcatattttatgatacatattatatataagatcatattttatgatacatattatatataagatcatattttatgatacatattatatataatatcatattttatgatatatcttatatataatatcatattttatgatatatcttatatataatataatattttatgatatatcttatatataatataatattttatgatatatcttatatataatataatattttatgatatatcttatatatattttatcttatatattatatatgatataatattttatcttatatattatatatgatataatattttatcacatatattatatatgataaaatattttatcacatatattatatatgatataatattttataatattttatcatatacaatctataatataatattttataatatatattatatacaatataatatgttataatatatattatattatatataatataatgttttataatatataatatgttatataaaatataatatattatatataatataatattttataatatataatatattacatataatatatataacatattttatatataatacattatatataatatatattctatatattctatatagaatatagaatatatattctatatagaatatatagatatatattgtattatatataaaatatgttatattacatatataacatatattatatatatatagagagagagagagagagagagagaaaatgactagagctgattctcttggcaatgtgtggatgctactagaagatggcctttaacgaccaggaagttgccctcatcagacaccagattggctagtgtcttgatcttggacttgtcagcctccagaactgcaagatataaatgttgcataagctaaaccaaaacaaaacaatcttctaaaatttaaaggatgatgataacaagcatgataacatttggctggtgatttaaagtttgcaaagaatgtttaatagtcccaactattccatgagtcatgcagggcagacgtgattatgtttatatcttcatgaggaccctgaggttcactggcaggaaataacattcttaataccattcagcaatttccttgtgtcactgggattctgaaccatgtattttatacatagaacacatgctcactttttttctgtgaattatctgtcatatattggtaagggagccagttaaaatcttctgtgactttctgacattatgatttcttagaagatttcaggtaattctaatgttcagccaggtctgagaaccactggtctagaataagaagagtgcaaccaggtgtttgtcatgtgagaaaaatagggcatatgaagacttgttgagaaaacttggaatgctatcttggacaagaaagtaattataagaaaaggtttgacttagctctactgtactaggcagaactagagaaaatggtggaagttatagagatacaggtgtcagaaaaatagaagccttgaaattcacagaattaaaatatcgcaataataaacgtaagccttgtgaagttgtagccttcagaaaactgctcaaacaaaaatggacaaccatagatcaagaaaaatggtggcagtcggaattcaatgcagatgtaaaaaataactagatctcagatttcaagatacttaataaaatttcacatttgtcttgagacctaattcccattcttctgttcatgactatttaatattttgtgcatttgttaaatattaataatcaaaacaaatgtgtttattaaaaatgatcttttttgcttctttctttgtggtctgatctattttttaatataacttttcaaatacttagggggctgttttttacacaatcacttgcaacctaatctttatagccttagttgacagactgcctgctgaaactaaccgagagcaaagttaatgactttggtaaggccagttaaaaaaaagtgatgtatttgagaaggcaagaaatgcaaacactccttatacctacatgttgacacctatctccctaagactcagcagtgttttagcttaattatttccggttttgtgactgacctacttgagatagttagaagtcaggtaggtatgtgactgggtgttactataaatacataagactataacaaattgggttgtagctcaaacctacagctagtggaagaaagcctcccaagagggctgtatagaaagatggtatttagtcttagaaataattactggcataagccctgaaagttatttatatagaatagaagaggtcagatgatattaagaaaggggatctccttaccctgtatcctcaaccagtactatacattaatgaattatgtgtataaagatgacccaaaagacatttaaagtgccttttgggtggtccaaaggagattaatacatatttagtatagaaagagacattcagaactggagggcaccacagagataattaatctgactatgttaattttacagatgaggaaaagaaacccagagaggcaaattcatttccacatattttatacctagttagcaaatgtcaggaagaaaaccagggttccaatttcctaatgcgtaatctttgtcattatccctcatcaaccctaccattcagcatgttttgttgttcttcagttcttattaattcttgggtcaaacttttatatcctttgtaactacaataattataaactagagtgccaattttcttgataactctagataaagaggcatttagaaaatgtgtccagcaagaaagaagtattccattctggagtaaccgtatatgttccatgtgagtttgagaacctgcctggagccaggcaacatcagaatatattctctacctctaactggaaaatttaagcacccctatctccatgtggaggttgataagtaattgttgtctatctatccattcattgattaattttccaatgttgggtcactgtttgttgtttttctttcatgtgcacttttttaaaaattatactttaagttctagggtacatgtgcacaacgtgcaggtttgtcacatatgtatacatgtgccatgttgctgtgctgcacccattaactcgtcatttacattaggtatatctcctaatgctatccctcccccagcccctcaccccacaacaggccatggtgtgtgatgttccccttcctgtgtccaagtgttctcattgttcaattcccacctatcagtgagaacatgcggtgtttgtttttttgtccttgctatagtttgctgagaatgatggtttccagctttatccatgtccctacaaaggacatgaactcatcttttttatggctgcatagtattccatggtgtatatgtgccacattttcttaatccagtctatcattgatggacatttgggttggttccaagtctttgctattgtgaatagtgccctaataaacatgcgtgtgcatgtgtctttatagcagcatgatttataatcctttgggtatataaccaataatgggatggttcggtcaaatggtatttctagttctagatgcttgaggaatcgccacactgtcttccacaatggttgaactagtttacagtcccaccaacagtgtaaaagtgttcctatttctccacatcctctctagcacctgttgtttcctgactttttaatgagctcttttctatgatacgctcctcttaatgtgaaacactatttaggaaaattttcatttttcatggtctctgaattgtatctaagaaatatggtatctaagaagtattacttttgagaaattaaaacttaaatttagtgaaaagtttgtgtatgtttgaaactatgtaaaggaaataaaacacaaatagcctgggtaatgtccaatctggtatgataacatgaattaatcaatttatgtctgtataattcatccaaagacacaagatacttccttatttttatgaatgtattatgaaacttctatttgtgtttttctgcttaagaatacaaataaaacattgtggttaccacaaatctgtataagatctatgaggaaagcttagactaacaaatattttcatggaatgcataacaaggggcttggatagtgctataaaacacaatcttagattctgttttttattaaaatactacttgatacagaaagaaaaccacatctgaaaattaataataaaaaccaataggaatgatggggagtgactctttaatgggtaaagagcttctgtttgggataatggaaaagttcgagaaatggatagtggtgatgattacatgacaaaataaagagaaaaaaagagaggcatatttacggtacagatatgtaaatatattcaatatatattaagtaaataagagagaacttgaggaacaagtttgaagagttaggatccatttgtcttagtccattcatgcttcaatataacaaaatatcttagaagggatactttataaagaacaggcatttatttgtcatggttctggaggctgggaagtccacaatcaagacatcagcagattcagtgcctggagaggtctgttctctgcttccaagatggtgccttgttgctgtttactgtgtcctcagataattgaagagcaaaaaggccaggcagctctctgaagcctcttttataagggtgttaatgccatttacaagagctcatgacttaatcacttcccaaaaggctccctcttaataccaacaaaatgggaattaagcttcaacatgaattttggagggacacaaacattcaaacagtagcaccattagtctctgtatattctatggatatccagcatatgtctagaaaacattctggaataatttaagttacataggagatttggttatggaggtactcaggttcaaaactgcagagttctgggttactaaatatgtttataataaatggacacatttttcatcagaagaaaatggtaaaaatgatatattttatgttacgtatgttttatgacaaaaaataaaaactagagcacataagacttcatggccatgacacctaataagactcctaataagaattctttgtacattttgtgcctttgttagacctgtagttcccattacacactatagaaaaagtagtattctatttttgtggcaaagaactataaggaaatcgttttattatttacaagatgggaaactttctggaaccacgagataagacatcccgttgcttgctcaaagtgagattaattaccttccttcatgtaaaactagaaaatattaaatgttatttcctcttccagagaaaatggcacagtcaagattagtgtgctgtgagcacagtgataattagcatctatcttcaggtaccctgaatcatacagagttttccattgaaggagagttgttatgatattgcaaagctcttttgaaggcaacaaaactagatttcctgttcaatttcttaaagttaatttatgtaagaatctcaataataattataggattagcaagtgcaatcatgaagaacatagcttgttaaggtatattaaggtgtataagcctcataaaataagatacttttgaaaataatttaatatttttgtaaaaatcattctgagaagttctttgaaccagcagaaacctatcctacgatataagataggaaaacaacttcagataagtttcttcccaaaacgtagattctagggtctctctcttctatcattatggatacatcagggccaagtgaattttttactttctactacatcctctctatatagataaattacaaactacaaagcaatggccatcagaaatttgaaacaaataaagtaaaaaagctcacttaaagctctcattcatgtaaagttagtatttttgtcataatgattctttcccatatgacaatccctcgtcccttactcctcacatggtcagctccatttcatccatcagggctaggtccgatgttaccttgctaaagagacattttccagattcatcacctgcctataatcctctcacatctattccatcaatccagcaagtcctgccacttctcctgcctgcataaatcccagaccttcccactccttgctatatccaagccatctctcaagcccagaccatcacatcttcctgggatctcttatccaattcccctgcttccattcttgtcctaactggacctacaccccacaccacagccaacatggtcttttcaaaactaaaaacaaatcatattatttccctgcttatacctttccaatggctccccattgaaatgtaaactaatcagacaaggagatgcctcctgatctggcctgtcttcctatttgagcttcaatcctactgtccagccattgtcctccgcactgactctgttcctacatcactgactttgaattgctagagcaagttagcctcttcccatctcagcggctgtgtactttctcttttctctgataataaaacatcttccttcagatgtttttgcattcttgtctcagcataagtgacacttcaccagaaaggacttctccaactaacccttctaggagaatagagtaactctcttccctccacatgttattccctatccaattactttgttttatcttgtttagagcacttatcatcatctgcaagcatcttatgcccttgtatgttttagtatttactacctgtgtacactgtaagctgcatgaagacagagacttgtcatgtttaatatggtaccctcagtacctagaaaagagcctgacaaatagaaggtactggatttgatgactgaatgaattaatatatgaattaactggataactctcattattctctaaattcttcattccttttcttcataacaccatattatatcatgtttatacacacacagatatacctgcttatttgcttcttttaaatttttgacttacttattaattgatttttggtctgtctcctccttaacctgtattctacatgaagacagtggtcatatctgtattatccgtatttcaaattttggaaatactttggtgtctgaaatattattagcactaaataacacctgatgaattaatgaatctgataaactattcaaacaagaagaatcaacaggtgtgccttagaaagtacatttccctttctgaattttatctcagatgaaataatgatgaaatcatgaaattacgaaatgatgaatacacccaattcttcactgatgcacttaagcaattgttatgattaaatgggggactttattgtaatgttaggaaaggaaaatttggaaaaatataactactacactacagtagagaaaactttggatcttgtttttcttatctctaaaatgtgaattaattgagattaaaatgatctctatataggaggtttgtcataacgtttgtttgtaaagtgttattgagtaaaaataattaactactattagagatgaagaaaatgagtctctaagagactataaaacttgttgtggtcatgcagttatgaagatgcagagctgggatttaacatttttcagtgtgatgctatcgtctatgcattttctactataccaattgattaaagtacattttaaaaaatgcaatgggcatgtattcagaattctggtaatttgttatagattactaatttgcatgttttattgctaccacctcctcttttaaattagtgtaactttttaaactaaggcttctgaaaataaatgattataattttaaaacatggtacataatttcaaaatctacacctagatttaaattccatgaggaggctgggcacgatggctcatgcctgtaatcccagaattttgggaggccgaggcggacgaatcacctgaggtcaagagtttcagaccagcctggcaacatgttgaaatcccatctctactaaaactacaaaaattagccaggcatggtggcacacgcctgtagtcctgctactcgggaggctgaggcaggagaatcgcttgaactcaggaggcagaggttgcggtgagctgaggagacagaggttgcagtgagctgagatcgtgctcaccactgcactccagcaagggtgacagagacagattctgtttcaaaaaaaaaaaatccatgaagaaatatgaaaactattaactttaattaatcaaaaataacttgggttatttccagataatataaaatgtttgttttttccacaatattttaatagtaaaatacaaaagaatcacagattctcttgccttgtttgtataccaagttagtaattccacatcctctgctccacaaaaaacaaaacaaacaaaaacaaccttatacaacatctgagaaacaggtaagaagttgctaccaaaactcctgaaattgattatatttatttatattctaaaacagtaaaatgttctgtatcctagaaaaagttttataattaatttttgccacaaattctctatctactaaatagggagaataactcatcaaagagtttgctgggggaattctaatgatcaaagcttaacagccaccgtatatactcatgtttcctttacatccccgtgcagtatttggtgtttagtaaagctgcttacaatgccaagtacatttcctttcaagtagataaaagccttgtgatagatgaatgtaataagatactaaaaacacccacagatatctaaatgatgtctatattacatccaatatagtcacagaaaatctttggaataatgtgagatctatggtatttcatattatttcaaagttcatactattttaaattaataaaactcatgaaaatcaattttctaaagtataacttcactgtttatatggccaaaagcacataaacagcactgcagaacataaatttttaagtgaagatttatttatatttcaatatattgctcacttaacattcttgtttactaaacacaggtgatcaaacagggaagaatttaattaaactgttcatcaaatgtttgatctttctcaaataaacttgtttttacggatggaaaaaaatcttagaataataaatctagctctcagtgaggtcttccttggatgttatggactaattttggaggttggaagaaaaatgcaaaggctgatctgcaaagcacttctgagaattttaagttcatcatttatctatggatttctccaaagcacatttgtttgggaaataagaatgctgctttgtatctttgtgactctgctagttagaggtataaatgtggaatctaatttaatctctttggatctcagttttcttatctctacaatgtgaattaattgagattaaaatcataatgaggatcataaatagaaaagtcttccttttttccagaactggagacttcaaaaaattaaacagacaacttttaaactaagaaaatatttgtgtcaatattgtctacatagcattaattatctggatggtaatttagcaatttaaaatgtcgatatatgctaacactagttagtcctgtgcacactcagaatactgactgttttctttattctgattctttagctgttgtgtgaatttagcttccagttaatatctaaaactgggttgagaatgggactattttatattatttttataaaacatggggacctaatatcccttattgctagattttttacattgctcataggagggattaccactgtaactgcataaagagcacttattaatttatgaaagttgagaaggtagtcattcgattttttttaattaaaaaaaggaaattgatttgtaaatttaatttcttaaatttgtgttttcatataacttcctggggcttgcaagagttgaaagctataatattactgccaagaagccaggaagaatgagtcatctagtcaggaaataaaggcaattaaggcttttaacctttcaccccttaaagacattttaacatatttcaatatgatcaaatctattgtgaattttctgaaaatctattgtaaagtttcttgatactttaaacaatatttaccgtatttgcaaggtatgtttcagtggttattaaaaatcccatttgtctttaaatactttaaaaactgggtgaaaaatcggaggaattaaatagtgaatgcaattaaatataaaatgtaagtttcggtgaattggcaaataaaattccacaattaccacattctacttgagtgccatgtgtctgtttgggaataatcgcattcttggctggacacagccgttgtgtgactcagagcctcatttcctcttacagcacatgggacccaatcctctggattctccaggaccagcttagctctacaatcctcctgccagataccactaaaacagaaggagctctcattgtaataaaaatacattttatgaattgaccacattttagtggagctggacaggagtccttcaaccagagtcttatctaaatcaattgaaagctatatgtcatggtcctccattgtattgtgccacagcagtggggacatttcagttgctgaatattatacttattgtacttaccatttttctgttcctccttcttgcttgcttatagatttttttttttttttggacagggccttgctgtgtctcccatgctggagttcagtggtgtgatcagagctcactgcagcctcaacctccccagctcaagtgatcctcccacctcagactcctgagtagctgggagtataggtgcgagccatcatgttcatctaatttatttttcactttttctagagacaaggtctccctctgttgcccaggctagttgtgaactccctggttcaagcaatcctcctgccttgaactcccaaagtgcagggattacaggcatgagccagagctcccagccaaccttttctctttctcttctgtcctttctgcgcatctacttttagcagctctgcatctacttatactgtgttgcttttctacaaagttcaaaggtggagcttagttcaggggctcattattactagcaatctgagctccaaatatgcaagttatttctgtaaataactaaaaaattgttcagtgctctaatcagctcatcatttggaaataaaatttaaaaatcttctcacgttaaaataaaattcagtattttatattctcattggaagaaaaacttgagtctatttacatcctttaatagaaatcttgaattctctctaaatatcacttaataacactctcatgctaaaatttacgatcatttttattatacatgccaatctaaatattttaatagaggcttttccaaaattgctaaagtaacttttaaatttttagttcattaattctagtaataacttcagtaagtgggagacagcaagaaatcttttaaaacaaatatactattgtaagataatttcacttggcaaagcttaagcaatgaatatggaatataatcatttatgttatattataatctgaatatatgttttgatcctttaagtaaaatactggtatagtcagaaaaaaagttgaaaatattttgtcccaaagtggtttatagttgtctcatatatatatcaaaagtttttaatttgtattttaagttcacagtatcaatatattctgttcaaaatgtatgagttacttcatatattcttcagagagaaacattttgacttcagaaagtaaactataatatcttactctcatattattgtttcatactatttatgatacaaataatataattatgttttatacaaatttccttttcttaagaatggcagagaaaaatccacgttagtgattcacaataaatgatcagattacaattgaaaattcaggggaaaactattggtaaataaatattttacatactgaattttttttaataacagtgatatctttgttaataaagaggatacatttaactaatgttttacttaggggcacttcattactcctggtaaataagacacggtgtataagatgcattctagataatgcattccaacatttctaacagatggcttaagagaagatagcaatttcgccctacattttattattttgccacttcttaccctgtatatctccacattctctgtcatctatcaacttacagcaccaggccatatacagtagtcctcacttattagtgggacatacgttccaagactcccagggatgcctaaaactgcagatagcaccaaaccctatacatatactatgttttattcttatgcatacatacctatgataaagtatgatttataaattaggcacagtaagagacgcacaataactaataataaaatagaacaattataacaatatactgtgataaaagctatgtgaatgtttattcgtgcaactttccatttgatatttttggaccatgatttaccacaggtaaccgaaactgaaaacaaaaatatggataagaggagggctatggtgactcaaagtctcagtggttctccattgcctaccaaaccaaatacagacgattttaggccttacagctactattgtttttcaagtactccactgcccattcaaaatatatgaacttcctaagaaattccaagcatcttcctagctcttcatctttgttcttgtatctgtggcacaggccactattttcccacctaaatctcttctctgcttgttccctatggatagagttgttgagtggtcacagttctgcttagttagaaaaaatttctcagcctccttgagtagaaatatattaataattaagttctcatcaataaaccatgagaagaagtaatatgcctgtcccgctgtgttctcttcctcttgtcatgagctggaagacaaacatgtctcctgcacagcttcaaacatgcagacaagaacaataccctagggtggtgctggtctctggaccggtagcagcagcagcatctgagatcttgttggaaacacaaattctcaagccccactgcaaatttaatgaagcagaaactcaggaaatgtggcccacaaatcagtgttttaacaagcttttcaggtgactatgaggcacactaaagtttggaaagcattgtcctaggtgatagtggaggaacaacttggatgaacctatattcacaaatggccatttggagcagtgtcatcccacttacccctctcatttcacaaagtttatttgtgaaatcatatagttctttaagttattgaattgttgagtctctgtcttacagaagtttagtatttgtcctaatagtatttttcaatatataatggctatttagtattcccaccctgtttaatatgtccacccgctaaaatggaaatctcacctaggtctctgcaagtttgcactggaaaactgtgtaacgccaaagaagaccaggccagttttgccttcctttaatctattatacacactgttgattaacattttttaaaaatggcaaatctaatctcatcactcttccatttcaaattgctactagactctcaaggcatttaggctacaagatagcatggttgcctaggcctataaggtgtcacctaaactgatccctatcagcctctccagtcttatctagagtcatttcacctttctctctgttctagctacactttctatctgtctgttcatgaactgtggtaagcttcttcatacctcagttttttctcatgaagttcactttcatgtcttacttctcatctttcaggtctcttctcaaatataatataatttcttcttctctccccccatttcaccctacagtattccatatgaatcaagtaaaaaatcttaaaatctcttatctcgcctgtacatttccactcatagcattaatttcctaaaaaaataatgtagtgctttctatgaatcattctattaggtgaaatatcctcctaaccccacccactatattacaagaagcttgatgagaggaggtaccatgtctacttgctcactatgtgcctagcatctggtagtaggcctgacacatggttagcattctgcaggaatgcatggagtgcaggaacaaaatagattatttgaagctcaaataacacgacaacttataactgaagactatttggatcctacttacttataaaaatgttgtttcctaaagttttatctattagagttatctctacctacttaatgggctcaaattcctgcttaacatatttgtattaatgattccatcagaaacaattttgatcaaggaatcttagattctaggttaggaatacgtcgtatctcatgcactgttgtgatttatttttctaaaagacaattttaattcagacttaccattgctaagtttttcaaaggatatccctttaataatgtacaatctcatcattccagaattcaaaactatttttggccataatctaggctatttcacactttccccagcaaggtagctattgtttcattcaaattagactattcaatatgtctcatacatctctacctcagggcctttgcacactttgttcctgtctgccagaaattctctcagaatttggacatttttctgagacatttctctcatggtgactaatcctgcctgctgattacctcttcattcttcaaggtccatttccagtgcatcccagtaaagcggctaaccaaacacaagttacatgcaggttgattcttgtcaatgtgggttcttatcagattagtggctccctggtcaccaggtttccctgtgaaagtgcttcacagtttgtttctatcttatgacatataaggaatacaaatacagtaagaatacttgaaagagaactttggggagtaaactcaaaaattcaaacagttctaaaatatcaaatgcataatcaattaattaaatggaaaatacagctctactttagagctataaaaagaagctaacatatgtgctgtaaaaaataataaatgtaaacagcaaaaaactaaattaaggtttagtatggagaaatctttagcactttgcacagtcctgaaaatgtgaatatctacaatatacatgtagggcattccagcatataacttagagcattgacacagaaattatcactggggaaaagggatgccatatgccacagtgggttatatcaaaatacaaagtttgaaaaatcatgggatatgtgatttacaattggtaagtttctgtttttctatttagttaaattaagtctcaaactccctcccttataaagacttactccagactttataacaacacttagttaatataaaaattatttgccccagatgagaatataaagcaacattgttgtaccaggagcctgatttgctagcaactccaatggctacattaagttattccaagcattgtcacactggtgttttcctgcaagagaatctcacagaggttcccagccctaggatctccctcgcctgagaacgtttggctctactaccaatttaacataccacggtatgttaaattcagttcccgggaagcaaagtacatgctgtagcctaataaaaaatttttgactaaggtactatgtgggagttgtactcaaggcattcttatttgtaaaggaaagaggaaagcatttaagaattatgaaggaaaccaagtgaaatgcttgattgaaagcacttggatctcagagctagctcttccccttaagaataatcctaatgcacattagggtatcaaaacattttttatttaagtactcagtcgatatgatttttcaaggtcaagatcattataacttcaaagtccctctgctcttctgaaggcagatgctactgaatgctacaaaatcagcaaaccaaattagtaactcaactaagcttcttgatgtaatgaagatgggctataaaacaggatgtaacttttttcttttaaaactaaataatggtattattcataaatgattatgggcattactccaaactgttcctctttgctcagccattattctagtcatatagcttaaaaaattgaagacttagaattacatgacaataatgacaaactctcccatctgtctttctgagagaggaggctccatcatctcctgaagcagaacacacccatgattagcccaagactaagaaatggcttcaaatctgatgagaggcactttgataatatgcctcttgctcccagggaaataaatctcagaattctagaagagaaagcagattgaatatttcatttctaaaaagtgatctgtgttcaagcaaaataaaaataagaaaatggtccttatactccctctggacagagagagtaaatacggtaaacaaatgactatacaatggcatgatcaagaaacattcccacagccttccaaaggaaaaggcagaatctatgtaaatagtgaaaggggtaaaagtatttaagggggtggagtgaaggtaagaatcacttggtatgttgagagaacaatgatccttaagaatttaaggatccttaagagttgatttggcgccactcctcctacatccaaatttttcttgaagagcatataaccaagaaagtatatatcttaaccataattattttattttaaatgagctgaaataaactctattgcaaatgggatttgaatagcttgaagataagagcaggttttggtccctcaccttttgtgtctgggtgtaccattagcttacacaaatttgaaatattaggttgatttaaaaaaattaaaaatgtatctatggaataaatttatgtggcagttctgattatgggccttcatttacaagaaaaaacaaggatctatggatcattaattaaaactaagcaattaaacaaaaacatttgcctgagctaaataggtttagaacattattttttggtatgattacataaaattgaatcattttatataggtggataatgattacatattactcctttgtatagctgagagagtacttacattaaactttaccttcttttccaaaaggccactaatagttatcatatataggccaggcacggtggctcatgcctgtaaccctagcactttgggagaccaaggttggcggattacttgaggtcgggagttctagaccagcctggccaacatggtgaaaccctgcctctactaaaaatacaaaaattagtcagaaattgctggaactcgggaggtgcagattacagtgagccaagatcgcgccacagcactccagtctgggcaacagagcgagactccatctcaaagaaaaaaaaaaaaagccatcacataaactctttccaagattaacaaaacttgataaatttgtcattttggagaagtttagcgtttttatttcatatactcgataaactgagactcagcacattctttggacattacataacataatcaatatttgaatctaggtatagaactggcttggtggcttggtatcttgtgccctgccattagaaagcacagtccattttaacagctcattttgcacctgccctggaattatgcagtctgattcacagtttcaggatgctattcagtccataaagggatttggaattgataacttcctcacatatttaaagttattctttggtcatattcaagttggtgatattcgtattttaatttacacaataaaagtctttcatgtatatcaagtataccaaggtgagttgcaaatccctgaatcttaagtcatgatttatattgtgccaaaattcttgctcattgcagaggaagaagtgaacacataaagcttctattactatagttatttgattggagacagcgacataactagaaataatagtcagcttcccaggagtgtccaaatgtatgaactaagatgtagtagtataaaaaaccaaggtgatcaaaaggagtttcatttcatgaaggctagatgaagtgcaattatatctagaaaagaaagtgaccactcaaaatcagtttaaaaataaaagaatggtcatcatggagaatttgtctttataggttaattcctttggacattagtaacttaaaatctatggaggcttggcatgaaggtcaaagatggcatgttaaatcttcagggcacacacatttacactaaaaaacacttctgtaagattgtttcaatcaacatttctgaacttatttgaccagggcattgtttttatatatgcataatactgacatgtctgtgaaggacgcttttggattagatgagataaagaatggtctaaaaagatgctaagtaaggactgaatctgtcctatgctcattgaactgcaaatctgagagttatcagaatattgcttatgtaagaggctgtcttctatgcaagtaaaaattgtaaatggtgatctgaggatcataactcctggaggcttcagtcttatcaattctatatagagatcagggggtaaggtgagatttttcctgatagaactagtgaatacattccttttgagagagaagttcctctgctgtgagtccctttacaacctcttttgggataggggtgtgaaaaggctactttctaacacctgacatatggaaaacacttgaaacaaattcatttaaggatctttgaaataagctcatgtggttgggagacatggatctggactctgaataatatctgacaacatgtaaatagtctgcgaacgctggagtctgactatcgtcaaggaaggctagatacactctcctcattggtttggaagagaaggaagaggagtgctaacagattgtctaggagaaggatgcatgagtgcttctctgtggactacatctgaaccatataggagggccagcattccattttgggtcctgcccaagagtgcctcctatcagaattttacctaaataaaaagataataatttagccaaaactcaaagagggcaaatcaccaaagaagctgcacattactcatccactatgtaaagccatgctataagattaaattgaaatttaaacatatacttttcataaaaagtaaaatttttaaaaagtaacataatgtccttaagacctatcctggattacactgactaaaaaatgagtacagaactttagaactaaacttcttggcagaacttggtttgtagacctaaaatttattcttttaatacaaaaattagtcaggcgtggtggcaggtgcctggaatcccaactacttgggagactgaggcaagagaatcatttgaaccccgaaggtagaggttgtagtgagctgagattgcaccactgcactccagcctgggtgacagagactccatttcaaaaaaaaaaagttatattcttttaatcagctgttcctgattacattgttccaaatgccagtaaataccaaagggttatactagttttcttgtcctctatcaaacacttataagatcaagaacttcatgatttgaattattacaaaatcataacatctttgcatacaaatatctatgattccataagtgaatacattgagtttccaagttaaacttggctaatacaggaaatttaaaaacataaactttgtgaacttatttaatatgcaataaaatgctaatcactgcaatcctggaagttaaacatttgttttcttattgagaaaatgtatagcaatgatgcagaccaaaaaaaaaagtgtgaaaggggcatttttattaaaagcaacataaaatgaaagaaaagcaacagtgtaagagaaacatcagatttaacgtgatgtagtcttatcttaaatctccataaaattagcccaaattcctttaagtatataattcttagttaaattcagcattgtataaagtctcttcttccttactacgttcttcgttctttccaattcatttggagactatttaaaaatgaacctcaaaccaatttttgtggtttatcttttcattacttcagtaataaaatgccaacttgctcactgtaatagctagtggcagtataattatattcaagggaaatatctaggttccctttctcatattgtgtgattatagtgttgaaaacttctgtaaataaagcagtaactgaaaacttctttggatgttttgaaaacaattctgagactaagctgttatcactcaccaagagaaatattctagagccattttaatcattactttcagaaacgctctttggcaaggtgcatgactctgtcaggatcaacaaagcccctacattacacattgttccattaatttaaaatattcttatttatctgtcagaaagctactgatgtttggtcaagaatattagtactgtcccaataccctatatttagccctagccaaagaaattcttcatgtgggaaaaaaaaatccaatgaataaatcattgcctatatttactttttctctctcttgtgagaaaagtttagagcagcaatcattttaattagcacattgagcataagaatgcatcacagcagttgttatatccagttttaagactggagagtgtggcgacttatctagatatacaggtaatatatgctcagctaagcatatggattgtaatataaattatgattatagatgagggggggtacagagggacatgcacaatagctgcctgtctccacttaatcagctaacatttttctaacacatacgagagaagggtttattttaactattgacatatgatagaaaatgagccatgataacatcttctatcagctttttacattttgaaatatatagctattttttctgtagatgtaaagtcacatttaaaaagattattattcaactgagaaatgagaagcaaaagatatgagaactatcttgaagaaacctcaaaatatcaaagaagatagtgtgtttttactttaaacattttatctcttttttttttttatagaggagatggtgtagttatcttgaacacaattcaatttactggttcaggttagctggttaaagacattggcgataaataaaacaaattaccttctcttgatactgccgcctcgaagaatccagagactggattaaagcggtggcatggccgacaaacatggcatagcaggtggccccgacgatcatgctcagcatggtaatccagaggtcagacatgctgactggggcttgggctccatacccaatgcacagcatgtgactcatagctttgaagagtgcgtatgaatactgctttccccaagaatcattctgcaacataagataaaaagaaaattgactgagccattaggatggcagaatgaaaagtgagtaggacctgtacacagaagcattataaaatactgaatactggaaaaatccttacaatggagcatttacaaatgtacttctcactaactgtgaattaaatgatgtttttcaaatctttcttactatgatgaagtggaaacagtctgctgttacttacatgcgctttgtcagttttaagtttgctgtttttaaaactaaaattccttttgggacaatggtatgccatgtaataatgacaagaatgaatgctttaaggtttcaaggaaatgtggtcaaatagtattaataatatatttgcaagctatgaaatgcagcagacagtatgacacatacaggccaaagtataaacatttttatcaaaaccatgaagttcagattttaaaaatccatattgatatagctgtatagtccttaccactacaactttccttaaataaaaatttgaacaaatatatattggaaatacaggtctgataaatggaaagacttccttgaagccctctctcgaagtgatgtatattgtaatttgtgtcaggattgaagacggctgaatcttgttggctttttataaaataataaaatgaaataggcaaaagaacatcttggcttatgtcctggagaaaacaataggaaatgctgacttctgagattatttattagttgtaacttctgatgtcatttaaaaaaaattgcaagctcaattttttaaaaatgctgtccaatgtatcttatctaatttttgttaaaatttaaattattttttggataaattttattgaactccctaattcaagtattacacaatttataaaagccagagcaaaatgaaaatgagggggctctggttcaaaatgcgggaaaaaaacttattaaatataataaaatataaagatttttcctttaaaactactttattatttataaaacctaatgtgataacagtgataaatgagtaaaaatataagcttacaaattttaaaaatcaatattttaatgtcatagttatatgtaataccataaataatactgtattaatgtgatattttgattggtcataaaatttttctggcttatttttctgaaattcatttcttagattatcaaaatttatacaattaacaactttattttcaatgatttagttgaaaatgacattagttgctcttggctattggaagattacttatttttaaatttaaatttaaattttaaattttacatatttttaaatttaaaaatgatctttctattaattcaaatgttattaaacctattaggagtattttataggctgtgagattagggtcaacttctgataatttatttaaaaatatatatttgagtacatttggagctgatgattttcatagaacaacttttcaataaatatttaacttatcatgccaatctgtttcataccaatttcacattgaatttagtttttatatctgaatttattttttaatttaactttttacttttaggtaattacagatttacatgcaagttataagaaataatagagagagattctatgtactcttcactcagcttccccagaggtaacatgctgcaaactatagaatagtttcatagtcaggaaattgacattgatataatgtactcatctcatttatagctcagtaatttaagtgtactcatttgtgtgcctatatgtgtgtgtgtgtatttatgtctatgcaattttgtcacatgtgtaggttcatgtatttattaccacagtcaagacacagaataattccatcacaagggtcacttatactgccttttattgaattgaatgttaaatttaaatgtatgcaaggatgttttagtgtttcttctgatatttcctgtaacttgtcaaggccgtgcaaaaaattgaaagtagtttcaagatttgcatataatttaaaatgcctgtttatatattgtattgctatatttttagttacaaagaaagtttaatttaaaaattatcttccttgttaataattggtttaatttaaaacttcatataaaaatcgtgttattttccatcaaatgtgagtcttaaatttaatttgtatttctaagtttatggacatctgctgtgcaattttgcagcagctttcaaaactggacattgtaaacactgaggaattctaatgactttctaaagtgcttactgccgtgcccatgtgtaaacatttattttgtaataatttatttacaaagtttactgcctgagtgccatgggtattgtcttggaatttaggtgggagatttaatatctgtttagatactacagggatggtcccttgggactgatgagcaagctctctactcaccatgggtgttctccctgcctgcatggatagccactttcatctctcacgactgcctttgttgctgctgcttctcctgctgctacagatagtcactcctaatctgggaccagtcctggtttggccacatcagggacacatagcatctagactgctgagtgatgcatatgctgccttgctgctaggccaattgcatgtctcctgtgcctacaggcctgaatctgtgtgtgtgatgctgccatcctgcagctctgctgctcatgttcacaccctgttgtcctagtggacttcacttacaaaacataagttcaaagataaaattattaagagtttcaagatggcaggagcagaacattaaaccaagcacagggttcttttgacagtgaggggctctgtgcaacttcaaggtcacatatcaatgaagccaaacctgcatttgtcaaattaactcttaaattatcataaacttttcaagctattttattttgaatagatatgggtagttttgtttgttgttaatagggttttccaacatcaaatttgtagatttaaacaataaaacagaagattgaaaagcccagtcttataaaccttggaactgcacatagttgctaaaaaataaagaaaataactagccccatttagctgaaaggattgaggttcttaaagtgaaattcactattatttaattataataaaagtcctgctcatattaaattatcctctctatatatgtattttcgcaaaagtaaaaaataagatttaattttaacacaagaaaattagttgtatgtcatattttaatatgtacatagtataataaactcatgcaaaaactcttattttggagaatgagcaaatttatactttactttatcagtgaaaatgtataatactcagaaatacatctaagatttccaaaattctagatggtccatgaacaagaaatggtatatttacatttactaaaatgtaaaatctaattcaagatttcctttctccacataagggtacagacaaggtatattgttaaagcatcttgaggtatttagataaaatggaaataataaaaagttcaatggggtgtcgagtggagactacactttatttctattggtattgtttatttctttttgtatgaatggaggcagggtatggagctggaaaagaaagtttaattcagtttttcagaataatacagctatgtctattctcatttatttcactagagacacaaaacacacacctgtgtatacatgctcttaaatgacttgaaataaatatatattaaaaatgctttttttttttttttttttttgagatggagtttcgctcttgttgcccaggctggagtgcaatggtgcaatctcaactcactgcaacctctgcctcctgggttcaagtgattcttttgcctcagcctcccgagtagctgggattagtaccaccatgcccagctaattttgcatttttagtagagacggggtttcaccatgttggtcgtactggtctcgaactcctcgaactcaaattccatcacctcaggcgatccacctgccttggcctcctaaagtgctgggattacaggcatgagccactgtgcccagcctaagaatgctttcttatttttaaaatcattagcaacttttctattttccattcttcacatgtttccattcctctttctctacctacatttccccaaaatcaggtatggatcattctgtgcctttctccatgttcatataatcacacacacatgcacatacacaaatccatgattctggctttttttcccacaaaaatgaatcctattatatatgctcttattgttgttatcacatataaaatgcctccaaataatctgttgttcacataactatgtaatagtttgttgatcacaccatagttaattcagtcattttttccattgttctccagcttttgccactacaaactattctttaattaaaaactttatccatatatcttttctttctgtcagtaacactcccaagagtgtgattgttggttcaaagagtaagattttcagtttgattttaaaatatattgccagattgatttaaaaggcagtaccttttccaatgtgtaaaaatatactgtatcaccttatagagtgagaaataataacccattgttatttttattagcatttccctagccaaggaatttgagaaggcgttcatgtatttatttaccaaatgggcttgctcatctctaatgaaatttttttttccttattaatttgcaatgcctccttgaagactgggtatcacccctttaactgatatgtgctataaatatttattcctaatttatcatttgcctattgaccttctaatcatataattactcatataaatatttcaattagtttatgtaggaaaattaaatctgtaagttccttggcagctgctggatttctcataatgattaaaaagctatctctaaataagattattcctatgtcctgaatgttttttcagattattttattttttatatttacttatacttacacgtattacctagagaaaggttttttttttttttggatatagaaaagttcacattttctttattctaaattaatggaatgtcttttgtgccagtatataacttttagtaaatcaacaggtctccatatagagaaatatatctcttttattatatattgtctctataaaaatggtatttgtgtctgggctcaatattttgtttcactgctctgtttagccacttttatactgagttttaattaaacaaggtttaattaaacaaggtccttgtttaaaaaacaaggaccatctcaattccaacaggggtttaaactgaactactgtgtgagggaatttgagtaagaccatgggtcatgcaggtaaaaatctaaaacacgaagtttgatggggagtaggagtatttggaggctgagaaaagttaccaaaccccatagtatgtgtgtgtacatatataaaattttagccagtctaaattgtagagaagaaacaggagggaatgaggagcataccagaaatatgacagaatagggaacataccaggcaacacagtgatgaccagagtctgagtccttaaacattttcagtacaaaacgggaagccaatgaaaacttgtgagcagagaatgatatgatctaaaccgtattttaggaagattgatcaggcagaattgcagagtgctggttcttaactaaggatgattttaccacttaggagacatggcaacatacaacatcagcagacattttagttttcacaactggcagaggtgctattaatatctaaagggtagaggccagtgatgctgttaaaaattctgcagttcagaggagactccctctcctgcctcacaacaaaaaattgggaggtccaaaatattagctgtggtgaggctgaaaaatcctgaggtagaggaaggatgtaataaggaccaaatacagaagtcagtataaatgttattacaagtttatgagaagtgaaatgagaacttaaataatataaaagtataaagcaacaacaataacaattttgagaagacagtatctacagaatgtagaatattagggattcatggaaaattcagaaggattaatgaaatataggctttctctctctctctcccccttcctctttctttccttctttcttcctttcctttcctttctttcctttctttcctccttccttccttccttccttccttccttccttccttccttccttccttcctctacttccttccctccctccctccctccttttcttttctttcttttgtctcactcttttatgcaagctggagtccagtggcataaccatagctcatagaatttgagctgtaacctcaaattcctgggctccagcaatcccatatcagccttctgagtagctgagactacaggcataagccactgtatctggtccttaggctattcttcatgaagagtgaatgattaggcataaggatcttctctgttactctacaaggccaatattgctttctttagacactgaattttgtctacacacattgcttgtgtttgcaagggccaagtgaaccataacaaaggaaagtgagcatttaagtagcagattctgaggctggtgttgaaagaattccaagtagaggaatgacatcctaacccctcctccatcatacctacatatcattaaaatcccaggaacaaagggcttgtattagtccattctcaggctgctaataaagatatacctgagactaggtaatttataaaggaaagtggtttaattgactcagttcagcatggccggggatgcctcaggaaacataaccatggcagaaggggaagcaaacacgcctttcttcacagggtggcaggaaagagaaatgccaagcaaaagggaaaaaggtcccttataaaaccatcagatctagtgagaactcactcactatcatgagaacagcagcatggggataactcccccaccatgattcaatcacctcccaccgggttcctctcacagcatgtggggattatgagaactacaattcaagatgagattttggtggggacacagccaaaccatatcagggctcaaggagaaaaaatagattgactgtgataaaacacacacaaaatgttatccttataagcagtatattataaatcaggtacatggttctaaactgttcaaagcaccaattattatgttaaactagtttaatcatgagtactattcttaccatcatttgacaaataatgacactgaagcagagaacctaagcgacttgcccagggttaaaattttgtaagtggaagattcagtgttttcaacccatgcagtctccttctaaggaccacagtattattacattacactgctctcatttttataagcctacaaaagtcataggtttttttgccccacttcgggcatcctgtttgccttattttaatctactaccattgaatgatggcttgaatgggagatttaggctatcatctgagaaagttttgtgaaaatctaggaatgtttgtaatcccattctgccttttttcttgtgttacatggctattcctttttcaccttgtaaagatgactgtattatattttagtgtacattactaatatgatattatatgcgaatgggagactgtatactcaaagtgttttaccatacagtccaaatatacccagtttcatataatctgaatcccacagacaataagcaaataaaatataagggaactgtttcaactgaggtttatcttgttttcattttaggtaacaatgtaccaacaaattgttccttttagattatgtttttgttattaaaagtgttcatttagttaatcacttcacttaggcatcactgaaaataatttttttttttttgaggaaaagatattgagtcaaattaatgggaacatagtaagtacctttgcttattccacctgagaactttctcttagtaataatgcattttgagctttctataggcttgaatgaaaatactttctagtcatcctgtccatattgttactaaatttagggagtcaggatgaagggctatttgcaaaaaaaaaaaaaaaaaaaaaaaaaaaaggaaaaagaaagaaaaaggaatatttattctccagtgtcctagacctcctgacataatatatccaattcaaacttagccactcagtagcctgccatgggaacaaaagctctccagtccactagctttcacatgagctgaaatttatttaatttagggggccaaaactttccattattgaatatcagaattaatttttctttattatttgcaagcaaatacaagtataaacgtgttgaagtaggtaaaatcttaggaaaatctaaaatatggcactcagagactctgaagtgcacaaaccaactgctaaaatattgaagaattaatggataataaagaggtgaaattagaaagccatgagtagagtataaattctttagagctaggctacagaatgttgatcaccatgtctatttttttcctgcagtcattgcataaacatatcatttttatcaattttggaaatgccaatcagatagaaagttgcatttaaaagttcttaaggaaaagaatatagtgtagcataattcatttgcagtcataagaagtataacaggtcatcagtgtcaaaaagagtgtgtttacttgaatacaccataattttattatctgtaaacagttggtctttgaacaatgcaggcgttaaggatgccaaccctgggcatagaatgacttttgacttaattaatcaattaattaattatttcgagacagggtcttgctctcttccctaggctggagtacattggcacaactatagttcactgcagctggaacttctaggctcaagtgaccctcctgcttcaacctcctgagtagctaggactatacacgtgcaccaacatgaccagcttatgtttaaaatttttatagagataaggtcttgctatgttgctgaagctggtttcaaactcctggcttgaagcaatcttcgtggctctgcctcccaaagtgctgggattataggcataagacactttgcccggcgtatttttcttatatttagtgctatgatctgcgtaaaaaacgtttgtacctctgataacaaccttttgccttataagagggtttaaacagtttttaacagtaaaatatagaagtattgcataactaaattactgttgccatgaagagtgatgtctgattattttgagagttcattctcaacttgttccatggtcaattaatcactcaagttctaagtgtactttttcttgcttcaagaatgatgataaaatacaaaatttgcattaaatagacttataaattaaaatttagtgatgcttgatatcacagattttttcttatttttttgatattggtacattattttaaaaataaaaattaaacaaatcaatgcattattttaaatttgacttgttcattcatccaattttttatactaagagttcattggtactatttataaaacaggccccaaatttgacattacttaaatactgtaagtgtgatgtttcaattacaattagcttttcaagtaaatcaaatatttctatggggtacctctttgttaacataaataaatataagcaaacatattttacatatgtttatatataagtattagtgaatatattttatgtgtatgcaagcatatatgcattaatataaagccagcatagaagaaatcagcatacactgaggacttatttactgcaaggtactattataacatcatctcattgctcttcttaacagtgaaacctaacttgatattgttattatggattggaaatgcaaacgttggaaaaattaaataacttgctttagttcacacacttgtaggtgccaaatctggaattcaatcacagatctgtctgaaccacactataaactctcttcattccaaagaccatagccatttatgtcataaccgtttatatgagtaaaattcatgataattatacttttatatgaataaaattcatgataattatacataggattttcaggcattttaagaacataaccataacagagaaattctttaaactatgtttcttctcaaccaccaaaagagagcctctattataccttaaggacatttagagaaaaattatctaaggttttcattagagaaaaacgctgaggtaaaatttcctggagagtgtgaggtcagtgaagatagtttgaccttaaaattgtactttagttttatactttcctattagtcaaaaacttttaatgaattcttctttccacctaaccccaaagcctgggatcaagcaatctatacagttatctgataggaacagtcctctagaagaaaatccttgcccgaggctcagcactccagagtatgaaaggtgcagatggcacagggtgacaggttcaatctgaaacactgagtgatgtgctttcactcaacacctggacaaagtaaaataagtacaatcatgcaccacataatgatgtttcagttaatgatggaccgtacattcagcagtggttctataagaagatgataatggagcagaaaaattcctatctcctagtgatcctgtagctatcataatgtcatagcacaatgcgtcactcatctgcttgtggcaatgtggtgtaaacaaacctactccactaccagtcatataaaagtatagcatatatgattatgtatggtatataatacttgaaaatgataataaacaactatgtcacgagtttatgtatttagtatactacctttttattgttactgtattctttcaacttatacaaaaataaagctacttgtaaaacaacctcaggtatgttcttcaggaggcatcgcagagaggctttttatttttatttttttagacagagtctcactctcgttccacaggctggagtgcagtggcgcgatcttggctcactgcaacctccgcctacctggctcatgtgagtctcctgcctcagcctcccaagtagctgggattacaggcacccaccagcatgcctggctaactttttgtatttttagtagagatggtgttttaccactggtctcgaactcctgacctcaggtgatctacctgcctcagcctcctaaagtgctgagattacaagcgtgagccaccatgcccggcccagaagaggcatttttatcataggagttgacaacattttgcatgctactgctcctgaagacattccagtgggacaaggtgtggtggtagaagacagtgatactgatgatcctgaccctgtgtaagcctaggcttatgtgtgtgcttgtgtcttagtttttaaccaaaagttttaaaagtaaagaaaaaatcaaatagaaaaaaatcatatagaatataagtacagggaaagaaaatatttttatacagttgtacaatgtgcttgtgtcttaagctaagtgttactacaaaaaaagtcaaaaacataaaaataaaaacattataaagtaaaaaagttagaataaactaaggttaatttattattaaagaaaatcttaaaaataaatttagtgtagcctaagtatacagtgtttataaagtctacagtagtgtacagtaatgtcctaggccttcacgttgccttactactccctgactcacccagagcagctttcagtcatgcaagctctattcacgatgtaccatcttttatctttcacactgttatacccttttattttttatactgtatttttattataccttttctatgtttagatacaccaatacttactgtgttaccaatgcctacagtattcagtacagtcaacatgctgtagaggtttgctgcctaggagcaataggccataccatatagcctaggtgtgtagtaggctatatcgtctaggtttgtgtaagtaccatctatgatgttttcacaatgataatattgcctaaggatatacttctcagagtgtttcttcatctttctaatgacaggcatgacattacattgctaagtactattaatgtgcacgtttaaattaattttatgaactttcaccaagcagctttacaatgatcattctcaaattagtagatcatctcttttatggcattcttgaagtgtttaatgctgctattttgaggtttgagcacactggagtgttaaaaactactaacaaagtgaaattaaagtgaaaacaaaaaacgttgtatatatttttgtgctgggctcaagtttctgctctttataaacaaagtagctgcctaatgcattaaagaagcagaagagttaagaatgtctttaatcatatgtgtagtctttgggtgtttatgtcggttatcagatcataaaatttattaaatatgcagttttgtatatggaattcttttaccatatatgagagtaaggcattagattttatttctagataatttgcatatatttcaatttatatgatagatggtacaatgtggaaagaatttggactttttatgataattaaacaagagactatataaaaggctgctatattaacaagctctatataaaagagctaataaataataagctttctgttttccaactgaaagagttttgtaaatgaggggataaatttcttaccgatgtgtgtgttttaatggaaaaatatgttcatagcacgttttgctatgagtaacaattctaacctctttgcaaatacataaatcatgaaaaatttattaaaatctaatgcttagagatgggcataactaaaatatagacaaacttaaactatagagaaaggaaatgtgtatgctgataagcagcttacgtagtaattggttatttatattgaggttaaaaagagctttcccattatctcaaaaatcatgctctcacctttacagattctaaaattccatcttagtaatggtagaatttacccttaacacttaacatgtccacgcaattttgatgacatggtgcaaacatctctgatttttttcttctacctagatttactactgggttggggttcccactaccagacataagaaaggatagtacaataaaataaaatagtggcacattaaatatttttatggtagactgacttttatccatcaattcatagaaagttggaattgtaagggatctgtataacaatttatcctttttataagtacactgaatttcagaatctccatgattataagatcaaaatacataaataaacaaataattaaatatattcagattacccaactttattcaaatctagtatgtaaggaacaatacatcttaaggtcatggaaaacattaagttacttgcccaaggtctgatctggtttgtctaagaattaaaaaacaaaacaaaaacaaaacaaacaaaaaatacaaactcatgtctgatgtgcttgcaagtattattttcattatatttgcataatcataatactgaccatagcacaactaacaatagcagaaacatgagtacagtttgcatagatctcttacaaggaacttaatagacatggtgattatcacaagagccttgtggtagcaagaacagtctttattatcttcatttactgatgtggataaagttcagagtttcattcagtagcctattgggtcatgataggtagcagtatctctctactggatctctaggctgctgattgcagatatagtgcttgcaaatctaattattattgtaatctatttggtaaaatgatgaagatactatgatctgtactgtccaatatttccatagagttatctatttcaggcaaaagtactcttatgagatctgtagctaatcaaattatatagagaaccattctcctatgctaaagttattttaatgaacatttagaacatgaatgacgtcagttaaaactactcccttactttattaaaaaagtatttttaaaagtcatattcttatttacagctaagttataattacataactcagcaacaacgcatgttcctcaactctaaagacatgactttaaattgcaaacaaataaataaagcttcaattacaagtaatgctagaactttgtttattgattatgaagtataacaagataagcctaggaaatcccctgctgtgtaagcctgtgtaaaaaggcagaaagtattaagcacttaaagctatttttagaagcctaattcccaacttaaattcttatcctatgttgtgtattcagtgtgttcttagtatgaaaggcttctgtgtcagttacccatctgagagaacatttagcattgacgtctaaatccacataagctgtatacaagtgtaagttttatcatgtgtagactccttgatctcacagacaacttcacagagaattcaaataccaaatagtatttaagagaggcaaaacacaacttcttagatcaacataatcaagctaaatacccttttactagcactcataaaggttaaatccctagagaatcacttgtctctgataaataaattctccactcacattacatttgagtctctctgtgtgtgtacattggggtgagggcatgaggaagagttggggagagagacagagagagactgagagatacagatttcttttcaaggcccagattattctctctcaggcatatctctcaattcagatgtagactgatttggaaatctgttagcaaacaagcacagagaaaagagtatttgcaacaatctgttttattttccctctctttcttttaacttctgttttttttttttattctacccagttacaagactaaaccaatggtgattcaggcgtaattcctatttctgatgagctcctttcagttatctaaaatcaggaaaaaaatgcatattcaatcatagtattactagtcaaagaaaataaagcgaagcagggcccctttaaaatttagtgcattccacttgaaatcatgctcatgaggatattctagctattttttatggcacagagaagaaaatgaaggttattttacctttaggaaataagtcatttttactgcatttctgaatgataaaaacattaagaaaaaggcaaatgcaatattataatccatttatgagatttctgttttcaggaatggagaagaaatgggcaaaataattaaatagacccagaaatggagcatccctgactccttcagtagaactcttatttgcttcaaatcctaatattacttaatgccaacagttcccacaattctgagtactttgggtatgaagcacaattactggcaatttttgaagggagcacaccacttagtgcaattcctgtagaagagtgaattataatttaatcaagcagaatgccaagtttgccacaaattggcagactaactttaaggaatatatccagacagatcataaaggtgtcttgccttaacctcctccaatgtggagggaaacaacagtatggcttactgacaaagcaagagaataccttaataattatcagcatacatttcttagtcaacagggactgttcaggaaaggaagtaaacattcaaagcttaatgatttctcttgtgcatagcttctgtgactcatgccagattttcctgagctagttctaaaatgatttatctgcttcagtgagtttaaagcatttcatcttcacttttctttgggcactgggaataaaggttaacaaagtcatctgcgtatattgaggtgtgggtatctgtgtatatctaccccaggctggcctagaagaagtgtagcattgtggtctcctttatgtacaagcaaacgtggtagcactgtacctccaggttctatggatagtggagccgggaacagtgtaagtctcaagggagacaactgcaatcacactgcagatgaggtttgggaggatagtacctaattctctgatgacagaaaaaaagacaaagaataacctactcagaaatctctcccatatcttcttctgagaggcttgaaattacctctattaagcttctctctatttacataagaaagtaaaatcaatggcaatgtctctggaaggctgttatttgaatgcgtgtatgttgcatttaagtcagtattcaaatagcctccttccatggcctggaggttgtatagtttgccccagtagggttcaggttgatccccaagaggctggaactgggtgagcacggattgacaaaggatgaagagagcatgaggatcatctcataagaaattattttggggatgaaaagaactgaatagcataaaagttaataaaaatggcagaggttggaccctccaattaaaaggagaacaagttagagtgaatgtatatcaagcacataagatggcatgcagaaagattgctattagttttgaacattcttggcttgcctttgccacctattgaaaatgcagtgtctggttaaaatggggaatgattcaaagggttctttttattctctaatcgattatggtgaagtgacatgctagattagtggtaagtcaccttagaaagttgcctaaggacaaaaaataagatgcgtacaattccatttggggaataaaaagttttacagaaacttagagtaggaaatagctaactcacaagaggttaaatcccagaacatttattattcacaatgaatgtgagatccaagcaaaggaatagagtatcaaagtaagtcaggaataaaaaaataaatattttaatttcagatattttttatgatttacctgaattcaacactgttgagatacagtatcattttgccagaagaggtaaatgtattgatattctttgtaaaccagtcggtgccttgagagaataaataatagcaatacggttattattagtcagcccaacacattgataatgacatagctgactgatgattccaattatacatgccaatttgaggatattcagatttgtttttggttatgtatttttccatagtttgttagctacaccatgcaggagcaaattgcgtaagtaagatgggtgggctgtcaacaaaatttaggttgaaaactttcagaggtagaaatgaaaaaggagaatattcagtattttaaatggcaataaataatcataaggatatgaaggggcaggaaaacttggttaaagtagtgatcttgataacattagccatataggaaaatttttattttagaatgcactatgacatttccaaagacaaatgcaataaggaatcaaggtgttttcaaagacaataatctactgcttggctgaaatattgaaaaaaatagattcataataaattatctttttttaggaaactaaatgatcaacaatatctctatgaatgtacaatacaaaaattaaaggcaatcttaaagcaggattcacatattttgaagctcaacaaattgttgccaaagtgtaagaaaaaacagtaaatacctgaactttgcagcataccctagatattaatcaattagaccatgggaaaaagaacaacagtttcagaaagcaaatctttatggccaattcgccaatattagcctatcataacataaatctgaaggcatcacagggactctgagctaccactcaatagactaagcaggagaaaatcttacatagtcttactattgagtgaactatcacaggtctcactccaataccatcttagttatttgttaatcttgtctccctcctccatgcctcaccttcccaaaaaacaatcaacagactaaaaacaaacctgggttactctcaattatttaggtgaacagagttgaatatcattcatctaaaaaagaggcctctctcttgacttctcatcttatctatatggaggcatttgtctctactcagctttacacaaacatcccaaatctgtgtgtccaaactgaattcatttaacctgagtatgctgctgataaaacatgttttctctgaatccctagatgagtttagtatcacttgattgactccatgctgtactcctcttttctccactgggtgggtccagagcttctagacagaagaacagctgaacagtatctgcttctactgttaccatttaaatactaaatagttatcaggctagcagcctggagagtgcatacttatcaaacaaccaatcaaacatacacaaatgacaattaaaaataatctttcttttgtcccatctctttacaatacacaggttcccattcctgcctagtgcttatctcagggcagtcttatggtatcacttgatttgagactatcttaggccctaggttacttctattattatatatttgccatatgtaaaatgacttggcatccttaataactatgcttgtcttttgtgcatttcttccttgtgacccttaataattctgaggtcagttgtttactttccaaggttttgttaaaaccaaattacacttccgtacactctgtcacaattagatatcatcctgtcatatcttgtaagcagtggttaaatgttaaacttaaccacctgttctttcaccaaccttggactttgattctgcctcttttatttctaggactacataagactttttctaaccatgattttactttgctctgaaattgaaaaatatagcagttatttgttttaatgaaaacaatgttttatcttttattttttcttttctagatcaatacaaattttaaaacaaattttaataatttgccatctcagtttaactccctttcagtccattcttcaaagcatctagttacacgtcaaatcatgccactcccatgcttaaagtttcctcatagcttcaagagtaagttgaacctctcatgagaatcacaaaaacttggtcatgatgtatcccctgcatctctcctgagcaatactgcttaactttcctaagccttataacaaaacctaagattgtactcctgccaccctgagctacttgcagttccccaaacaagccaattcattatttgccatgcttttatataggtagttttctctgactcagtgtgttttctggtctcctttctctttgactggacacttttaacagtgtttcaagatgcagctcattttgtaagtttctcaaagatcgaccttcatcccttcaattcagccttcccagcctggttcagcttcttgtctaaatggccacagcacttgtgcttccatttatcatgtgattgctgtaccgtctgtttatttgtttgccttcaccagtataaccaaagtttcctaagggcatagaccatgtcctaaacatctttgtatccaagacatttagcagagtgattgatatgagtggtatctaggaaaaatattgaactgacttaataacagtatacaaatgtcatcctgtttgataatgtaccttaagttatgttgtaagttaaaaagccagatgtcttcatctgagccacaaaagaaaccagtatctctccttaagattcagggtatttctaactatggttgaaatgtgaactttaaatttaatgaaattaaacagatgcctttagtagtctgatcaactgttctcccaattgatatatgtatagcagatatcataaacaattcagcatatattttaacactaatagaaaacttgaaataatgcaaaatatttcaaatttattaggtattattttaatcatgaatgcattgtcgggggtaagcatcactggctagttttcatacgttcatatatcccactcctcacttgatttactcgagtgaggaatgaaaatgtcccttcacaatgatatatttatgctttcctggactcaaagtgcctagagttaaatttggaaataccactgtagtaatgcaaatattattcttcacatatttttctgaggaaacaaatatggaatgcatatatgatatatacaacctgacaagctacacagcagaaattgcttttggtttccttagatgaagaaaacaaaaacagcactgacattgaaagtaaaaagtgtgttctattactcagatttagaaatgtgactagactagtgaaataagtgcttatagatttggtaagagaaggatgaaggcaaacgcataaatacacagtactatatatatgctattattgtttagccttagatgtttcctaagtatattagaaatgaaagcagaacaactttttcactttcataaacaattaattggataagattgtattcaatatgctcaaattttcattttaaggtagaaaataaaagtggcaaaagttttcccatagaagaataagctacagattttggaaaaataggagacactgaatcttgtctcccctctcccccaacaccttaaaaaaggacaaaggcaacacaaatatttcaaaacttttctgtttttaagtcttagtctttttgcctaatattagaatttcctaggcttcctagaatcattcatgtatggacaaaataacagagaacacatttaaatacactaaagtttgaacctgctttacaaacaaccctgaattagtttgaaattacgtaaaactcaaaattcagtagtaatgagaacattcagatgtggttttctctcagtgcagtgccaggcatgtagtgtgtagccattaaatattagcagattgtttattttcaagagatagctcacggtatctattgaaagttgacattttttttgtctctaggtgtacaaccaattaaacaagtggacactaataaatttccctttcacctactacattaatgtaatgtttctataatattttagtatgttaaaaaaacaaaatcctagcaattattgcagaagccatttttcatcagtattttatactaagctatgttaaggtcagaattaagggtagagtctatagtttgtatttactaagtcctgtagtatttgacctttaaatgctgttttgtcatagctattacagggaaagtgatagtgatatatccagtttcatttctaaaataaatacaaggtcattgcctccagcaggtgactggaaagaatacagtgtgatattcttaattgtgatatccaacataaagctgagaattttttagaccttctgaatgtactcaaaaatataaataaatataacaacaggttatccacagtcagctatgatcaatttaatttagccaagcagacaaaagcagcttccttaaataagagctacccagggtctcattagtgtagagagacaaaaaaaaaaaaaaaaaaaaaaaaaacaaggtcacgctcaaggtgtatgacttcatggtggaaaatttcaatcctccaaatacctcccagaaaagaaaccaaaggctagagaaacaactgtcaggcagatttcaaaatctcatttagaccactgaacaaataaaaagatagaaaaacgtgttaattctaaatatactgatatatatttttacaaagtaaggttgacaaagttgaagttgggcatggaatgtctcttattagaatggcataaagaattcactgcacaagtttgaatctggaaaagtgagtacctaaaataataaagtggcaattttctgagaattaaattttaggaaaaaagtaaacaaaggactacaaattgattttatcaatagatacaaatgcattttcgttatttatcttttaatcttgtcttggcatatttagaatgataaaagaaaaagtgtttataatgtactctgttgaaatgcaagcaaagaaaggtgagaaaacatattcattaaactatatttattcaacaatatatgcaaacataaggataagatacgtttttctacattatacatgcttctatttctccctccttcataaatatgatgaggccaaatcagcattattttttagctcagatgagctctgtgataggctaaaaactatcacctatcacagagctcatctgagctaacaaataatgctgatagcattaatggacttctaatttatttaatattgttttacatgcagcttttaagatcaagcaatctgatcctttctaaaagatattatggtagaataaaggtcacatatttaggctggcaaacccatgaggagaataatagtgcatttcccattagaatctaatgctgataaatcaacgtaactgtcaacagctgagtcctaagattaacacagatgtggaaaaggaaggtaaaatacaattatgaaaatggaagcaaacagtatgcttaaggatgtcagatatctgggaattccttttttgagcagaaaatataaatctataagccagttttcctttagaaagttctaatgcctctctgtaagaatattttattttaatttgaagatttatatataattctatatgtcattaacataatcagatccagaagtatcaccagagcacaaattacacaataaaattgaagtgactatcttcaccacagactgctatgtgatttatagtgatgcatttcaattccacttgcatttgtgcccgctttgtgttagaaatcatcaaagatggagaacttagtttttgccaggtatcttcctggacactttcaggaacttgggatgaactttgggaaagctcagcatgtggtacactatgacactttacaagcttcctatgttgaaaaaacctaaaggactttgagctattatttcatatcttgaaagaactatggcatagcaactaggataggaaagcatcatggaaacactggaacaagttaccaagtaactgcttacccagtaccagcaagtagctaatgagaagcacctcagatgcaaagaaccagcaccctatgagacaggctgataccctcggagtgtgaagaatgagacaaaaagaagcacacaagagtgtgctaattagaaacctaaaggagtactgataaccaggacgccaagcaatccagaatcagaagccctctaagatatttgagtaaataagagagtgtttatattatactaataagacagtgtttctgttacctaagaatgagccattgtactggaaatctctttgtccctccaaatctgttcttcagctaccttttgttcaggaaattgacctgtatggattccaacaacaaactccattaccctctgacctcagttggattaggctaatggagaaccctgaaagaagatcagacagaagaaggaaaatgtgaccagtactggggctcccgctttgaagacagtgagctggctgtgtttcctgttgaaggtcactactcctgtcaatgcagtcctgtctacattactttcttttctgggttttagcattggtaacatttctgttactactattcctggggtccctgatctcctctttagtccccaacattccacccacaacttggtaaacagtcttctttttaaaacttccttcaactttgtaacttaagagtgacatctgttctctgttgggaccctgcctgtgtagcatataggtagaaaggggagaatgcacatgggaaaacggaaagaaaactcacatgagagtcaagaaacattggctcaacatctatcactaataaatctatgcactgaagaaagccatttatcttctctaggcatctttttatttttaaagagcaaatttgcgaagggatctgaagtttctttttgcctttaaaaatttatatttctatgactctaaatatagaaaacatgattataagacagttggtatctgtttttttacatccttcttgcatcctgtggcacactactgattgctttatcaatattcatccttattctgctacagaaccccccaaaatttggggtggcaacatgcccagcttaataaaacatatgatttatacattttggaagaatagggcagccaagtgatttagtattggctaatgaggtaaaagtcaaagttactggatggggcctctggaaacatgtaaggctgtctcaggggaatgtgtgctttttctgccctctgtccttcctattctttcctgaaatttgggtgtaatagttagggtggggaggtcttccggagagtgatcgtggcaggctggtgcgacaacatgtggaagtggcatgccagccttgggtggtctttcaacttatttcctgagagagcttacataatgacgtttttggtgtttctccaacataaagtctttttttatttctctaactcaaagtagaacataatcactgttatacacacacacacaaacacacacacaccatttactcctcgaaacactcagatcaggactctgtacttaaatgtcacaataaagtctacttcccatttttagtcatataagcaatccagtgcctcaaagtttaccagcactgtgctgaaaaccaggtaaggctctaattcccaaagtgacagctaacttgtctaatccatgtggtttccttatcctaaaacttaccagtttcacttacagttagatacccaagagaaactcctgcacaattacacttgttaagaagaatgttcacagcggcatggcttttctttctttcttcctttctttcctttccttccttctctctttctctctttcttctttcttttttttttgacagagtcttgctctgtcgcccaggctggagtgcagtggtgcgatctcagctcaatgcaagctctgcctcctgggttcacaccattctcctgcctcagcttcctgagtagctgggactacaggcgccagccaccaagcccgtctaattttttgtatttttagtagagactgggtttcactgtgttagccaggatggtctcgatctcctgatctcgtgatccacccgcctgggcctcccaaagtgctgggattacaggcgtgagccaccacgcccggccagcagcatggtttttaacaacaaaaaaactagagattgtatacagatgccatgggatatcatactgcattgaaaatgagtcaactacagcaataagcaactatatggattaatatgtcaacaaaataatgagtgaaggaagcaaaccttgtaagataaaggaacagcttattaacctttacataaagttaaaacaaaacaaaaaaaaaccaagaaacagaaaccaacagtatattccaaaaaatatattggtttgatttaatatatattttaaatctattttttaaagtaaaggaactgaaatatacagatttcaatgttgaatgctatcttaaccagtttgggttactcgaataaaatacaatggactgatgtcttaaacaacaaacattaatttatcacagttctgaaagtgggaagtccaaaagtgtcagtatggtggaattcttgctcaggtttgtcatcctgactatgtcctcatgtagcatttccttggtgcttgcacacatagaaagattttctcccctactttttataaaggcactaatcccattcatggggtacaggacacactaccccaaaatatggcaccttgaaaactgagaaaacagcaaaagcaggaaggtcactctctgatcttttcccactttctgtgtgagagctagacataacagaattttctgacctatcttccctgaaatatatataaccctcacatataacaagtgccctgcccatgtgtggaagaaaggaataaaaacacagagatgacaacaagaatctgaacaaacaggccttgctaagtttcccccagtttattgccattagatcatgttgccttttgtccaatcatacttctacatgactgtctactcttcatcaaacctaagcataaaaatacaggtatgcggttttccctgtttctgtgggtcttcctttccaaaggctcttgtgccacataaaactttgtttaaataaatttgtaatatttttctcttgttaatatttcttttgttgtagaggtgtcagctacgaatcttgccgtgggtgaggaaaagatactacttttctctcccctatgatgtcattggagcctctaccctcataactcacttaaacctaatcacccctcaagggccaaacctccaaaaaccattgctttgaagattaggacttcaacatatgaattttggaaagacacaaacatttagtccataaaaatgtcaactttctaacactattattaaataattataaccataaatttgtgcatgtagacagacaaatatttggcttagggcccacttttctaaactaatcaaaccatttcagaaaaccttccagaatcagcaatagtttttttattcaccataatacatcagtttaaaaaatatatatatcacttaactctcccaccccttttatatttctgcaactcacaaagtcatatatgagagctaaaaattaaaatgatcaacctcatgaaaatgagagtaaaatgatggttactagagactgagaagggtagtagggagtgggggattaggtgagggtggttaatgggtgcaatgacatatttagatagaacgaataagatcttgtatttgcctgcacaacaaggtgactacagtcaataatcatttattattatttagttattaaaaataactaaaagctttgagtacaattggaatgttcctaacacaaagataaatgcatgaggtgatggatattccaattaccctgatatgattattacatattctattcctatatcaaaacttcacatgtaccccataaatacatgcacctactatgtacccataaaattttaaaaattaaaaaaatacttattgttaccttctagcttattttacattactgaggtgttaatgggataaaacatgaagctcaagaagcagaatagagatggattactgcatgtggcttaagagtaagagacacaaaaatctcctaaatccatctcctttggtctagcattcaaggtgccacacaatcaggctccagcctcttttcctacctttctaacttactctatttcaatcacccttcacaaagcctccactgtagtcaatctcctaactccccaacaacacttagactttcctgcatcagtgtttctcctaaggactatttttgttcactacattctacatgtctggaaaactgtcttctctgtctacatatttcaatcatatccattcttgaatatccagctcgtattttttcttcttctttgaaactattttcttagacttgctatacaaattctcatttgtaaaaagcttatttgttagccaatctgtacagcatcatctgctctcaactcacttgtttactatcatattaggacttctcgcagtgcctacctagaatgggatagaggttcaataaagagtttccaaacatctaaactccaaaatatcttcaactactctcttgaaattttctttaaattgcatatttttatttttctattgtcttcctacctaaacctctttgagagaaagaactatgcttattgtatacttttcctgatcttgctaaattcattgcttaaagtgctccataaaaattgatgtttgcctttaaaagaataaaaacattaaagcagttgggcacggtggctcatgcctgtaatcccagcactttgggaggccgaggagggcggatcacgaggtcaggaaatcgagaccatcctggctaacatggtgaaaccccatctctactaaaaatccaaaaaaaaaaaaaaaaaaaaaaaattagccaggcttggtggcgggcacctgtagtcccagctactcaggaggctgaggcaggagaatggcgtgaacccgggagttggagcttgccttgggcagagatcgcaccactgcattccagcctgggtgatagagctagactccgcctcaaacaaacaaacaaacaaaaaacaaaaacaaaaaaaataaaaacaacaacaactaaaattaaagctgtgcctaagaatcgtgtcaacatattaatttcctctcttttaaaaacacaccatgaaatcaagtcctaataatttctgcagaaaataagaagattaaatttattttttgagtcaggttacatatggttcagaatcacaacacaggagagaaaaaaattcttcataatcaaatttgccaaaatgttccaaaatctggggaaacagtattactttcactaataagatgccatgaaatgcaatataaaatcacaaatattattaaattatttcataaactacatttggagatttttaaaaataactttagcactttcctattatatatatttttgctgtttattactgacaatgttgaaaatgtatctagaatacagagttgcagtcttagtattttagttctccattaatgaataagattagattaaataaacaatgcgatagaaaaataacgtttactgctgttgtctatcctggaaagcacattcatttctctcatactgtgtatatacatgcatatacatatacacatgtagtttatatattacacataggaaattatccatatcatcactaattataatagatgttttcaatcaaggggtcatttcttatcaatctcattaacggtccatagtttgggtgtttgtcatttgaatataattaaaccggagaaaatggcatcgatgttttattacaattacctagaatataatgcctggcacactgtaactgacagcaagggataagtggtggtttgtactttttcttgccaaacttttaaactagtccctattgccgggcataatataaaatcaacagcataagttaactgcagtggtatatgcccacacttaacagcttctgccttcttaccctgtgcatcactcaattaagtacttaacacagtttatatgcacataattataattaactccatctgtgtggcatttcacttaataccaagaaattcatttatttgatcatttgataaactcaaaaatcattcattaaatcctttgacattaattacaaaagtgcataaaataactctaggataattcttgttaacatattagtaatcacatcaagatgtcaaataatactttcaagtagaactgggtaagttagtgattttagctgagaagatggcagaagaaatttcatatgaggatggtagtgatcgaaagagagggcaggagaaataaagatttagaggagaaaataatctaattcccagtaaattagaacaaagaaacaactactttgtaaaggactaagtaatgaagtagtttgagccatttgaggaagagctttgaattaattctatgctacacattttaaaatgaattagagatttagaaaagaatcattggaattcaaggatagaaatgtattgtgattttattcattgattaagagattttaccgacagaagagtgtgatacggaatcaagtcaggagagaagggaggctggcagattaactaagggatttcgtttgtaacctaaatatgaaataatacttgaaaaagacagatgcttgggaatgacaaaagatagaacacataaaaagcatataacaaactagaacttgatgtgaaagcaaaaatgagctgattaatggtgttgttgtaattctgtgggaatgagaagataggtactaggtatatatgttcctgagccaggataaacaagattcttctatgccgcctctcctctcttaaagtagggtttcatctttctctgtagttaattccatttaactgtttgaataggcaaaaattgttgaaatcaagtatgatgaatctcatgcatgtgattcttacgttgcaatatttacatgtatggtgaatacctttttgttctgtccattttagggctcacttatttggaaacctccaaacaaatggattatggagctaatgtgaatggttagtcatggaaatctctctcttttcttcatgggagcaagaacttaaacaaacaggatatgtccctgatatggtttggttctgtgtctccacccaaatctcaccttgaattgtaatagtccccacatgtcatgggagggacctggtggaggtaattgaatcgtggttgtgagttttacctgtgctgttctcatgatcgtgaataagtctcatgagatctgatggttttacaaaggggagtttccctgcacatactttctcttgcctgctggcatgtaagacataactttgctctttcttccccttctgccatgattgtgaggcctcctcagctgtgtggaactgtgagttcgttaaacctctttcctttataaattacccagtctcaggtatgtgtttattagcagcatgagaacgaactaatacagtccctgagaagaattcagaagcactcaagtctgctcttcatatgaaatctgagaatgtgtgtttatgtatttaactgtactaaaaataaaaaaccttacatttcttctccaattgcctgctaaactaaaggaaaaattttaaactatagtgtagacaaaagtaattatgtaatctgaatttgtaataaaatttagcagtttctatgtcacatgaaaggtatactcaacagtcttgcaatgttttatactatatggctataattataataaatatacatattcattatattataatatgaattttaattcataatacatacctataatatgacacacatattcgagtagtcttgccgtgcttcaaatgagataaggttaaattctttttgcataccagcattttctatgagttgactcctacacagcatgttgacattggtcagctgtatttttcttaaaatgttttcttcttaaggtgcttcttacaagctgcttgtttctaagataccaagataccaagggctgaatacatcacaattttctacctttaaatgtcaaaagcaaaacagaaaaaaaaaatacaaaagaactagtggctgttcccagaatgtagtacactggcttatcttgtttattttttatgacaagtggtaccaaatccaggttttagtttttaggttttagttctatttttatagttaacattaagtcttataactgttctgctaataaaaaatctttgcctctttctaaaatatctgaatatttatgttttctccaaaatctgttcaatctctcttcctatactattcctaggtatcctacaaattaacttgcaaagcagtcaggtgttttgttagatgtgaccaaaatctagatttttgacaacataatttttggggaaaagttataattacattgatcaataattagtgttggtaaaatgtaatattcctaagatatagatacatatatcaaatgtttggttgcactaaattgcttttatttgttcttgtgcttgttgactatagttattgataacatttttacattaaaacaaagtataaaatgtttttatgtcatgtagcataagagtattacaagagagtattcaggtccttgctcaacttggctctgaaaacagatcctgctttgctatgattgtatgaagatagttttttcattatgctccattttcaaaattttagagcattatctgaaggagaactttatatcctcagcctgtgaaatctgtagtatggtggaaagagggtgtattgtagagttagatggttcttaagtaaaattcttacttggttttttacttgctgtttttcattgttcaagccacttaatatctatgaacctgtattcacttctattctttatctatggataaaactcatagaaacattaaaagaattaaataagataatgaatgcaaagcacctggcatatgatagatgcaacatttgtaaatactttgaaaaaaacagaactactactcctagtctcactatgaaacaattgatatattgtacaatttgatttttagagatgattttggtcagtttcaaattttcttctaggagttcagttctcctgttaatgttaatgagtttattttatttagaattttgatgatcaatgtcaagtttctcttgggtccttactttcccttcttctttatcattaacttgcttttcaactatcttattgctaacttgaagaaatttagaatcattcatttaaaaaaaattcatgtcactctaattcactgtgtactcataaatttgtaaaaatgaattacattagcaaattttgtatttaagtatttaatagctaatttatatacacatttaatttttaactttgttttactagcaataaaggcaactgcacatttttatattaaacatttagtatgatttgaactgatttaatatctttcatttattattaaattaatgcattgttatcaccctgcagcatttggaaaccaaatttgggcttgaaataatatagcaaaaagatagaaaggctggaatgagtaacagtccactgaaatgacagaaaaagctgaaatagcaaggaaaggataggaaagattaaaaagctaaataaaatattaatgtactatatatattatacacaatataatgtttcatatgtaatcggaaaagtgcataaggaagtcaataaaggcttgagagaaaaaatggaaacaatattctgtacccaactggaaaatacctagtacaaaataatagtaatgttagccaggaacttgacaaattattttgaataaagtattctaagggctttgaatgcattgtcatttagccctcaaaataacctttagaggtttgaattattattatctttataggtgatggaactgatgctcaaagaagttaatgtgcactctgagaatcacagaatttataagaaatgatggcaatgacaatctcaagattttgtctcaatagccacctcttctagttatacattattgtaaaagaaaccagcccaaaagttagtggattaaaataacaatcatttacttttcccaggaatgtgaaatttgggcagggctcagcaagaatggctcttctctgatctgttcagctttatatgggggcttctcaaccggggctagataatccacttccaatatatatcccttactcacatagctgacaagttagtgctggctgtgtattaaaacctcagctggggctaatggctggggagggagagctcatctcttttgagaggggtgaatgtgaggacacgagttgcatgacagataagaaaaaaaaaggtgcaatcaattaattgatttaatttcccagtgggctgtaaacatttctggaattgagaaaatagagggaataaactggaaagctatgaactcatggccagaaagcagaatgtttgagattttggaaggaatattgaattggtaatgaaagtgtctgggcaaagagcttaagagtgagtggctgtggtaggctggcagataggtcatcgaaggaggtgaaagagtcatctatttggatactgaaatccagaagaaaaatagcagaagtagtagtggacacactgacagtgagcctggagatgagaccttcaaacaacataggaaagtaattttcatggggcataggggagaagtggtggggatagactataatatggagtggtagttaacagtacagtaatgatatcaaagatggatttttttttttaagaaaggcaagataatgttccgtaagcagtaatataaataagaattgagctattataagtacaaagactctaggcataaagaaatacaaacacaaaacaaaaatcttccaatatattatttcttataaatccctggataataaaattaatataaaagaataaaactccaacattcatcaaattatctgtcttacaattaggcagatcctaattacagaaagaataggtaacactgacatgactaaaaatgtgacttagccacagcaatttgctgagttgatctcaaaagtggtaagaccatgttatagtcgatgattcttaacttttattttatggttcaggggtacatgtgtaggtttgttatataggtaaactgtgtgtcttaggggtttggtgtacagattattttgtcatccaggtaatcagcataataacagataggtagtttttttttttttattctctcccttctcccaccctccaccctcaagtctgccccagtgtttgctgctcccctctttgtgtccatgtgttcttattgtttagttcccacttataagcgagaatatgtggtattattctttctcttcctacattagttaacttaggataatgccttgggctccatgttgctgcaaagaacatgatattgttcttttttatggatgtgtagtatcccatggtgtttatataccacattttttaaaatttactccatcatcgggcgcttgtagtcccagctactcaggaggctgaggcaggagaatggcgtgaacatgggaggtggagcttgcagtgagctgaggtcgcaccactggactccagcctgggcgacagagcgagactctgcctcaaaaaaaagaaaaattactccactattcatgggcatttaggctgattccatgtctttgctattgtgaatagtgctgcaatgaatatatgtgccatgtgtctttatgatacaatgatttatattcctttgggtatatacccaatattaggattcctgggtcaaattataatcttgttttaagttctttgaggaattgctacactgctttccacaatggttgaactaaactcccagcagcagtgtataagcattctcttttctctgtaactttaccagcatctgttattttttggctttttactagtagccattctgaatcgtgtgaaatggcatctcatttgtggttttgatttgcatttctctaatgattagtaatgttgaatactttttcatatgcacttgttggctgcatgtatgtcttcttttgaaaagtgtctcttcatgtcctttgccctctttttaatggggttgtttttttgcttgtaaatttaatttattcatagattttggatattagactttgatgcatagtttgtaaatattttatcacattctctatgctgtctgtttactctgttgataggttcttttgctgtgcagaaactcttgagcttaattaggtttccgttctcaatttttgcttttgttgcaattgcttttggcatctttatcatgaaatatttgctggttcctatgtccagaatggtatttcctaggttatcttccagggtctttacagttttaggttctatatttaagtcattaatccatcatgagttgatttttgtgtatggtatagggaacggatccagtttcaatcttttgcacatggctaaccaattatccccaaaccatttattgactagggagtcctttctccgttgcttgtttttgtcaactttgtcaaagataagatgattataggtgtgtagcattatttctgggctctctattctgctctattggtctatgtacctttttttgtagcgccaccatactgttttggttactgtaggcttgtaacacagtttgaggtcggataacatgatgcctccagctttgctctttttgcttaggattgccttggctatttaggctcttttttgatttcatatgaattttaaaatagcttttttctaattctatgagaatgtcattggtagtttcatacaaatagcattgaatctgcaaattgttttaggcagcatgaccattttaacgatattgattttttcctatccatgagcgtataatgtttttccatttgtcgctgtcatctctgatttctttgagcagtgtctggcagttcttattgcaatttttcacctccctagtttgctgtattcctaggtattttattctttttgtgactactttgaatggcattgctttcctgatttggctctcagcttgaatgttgttggtgtataggaatgatattaatttttgtacactgattttgtatcctgaaactttgctgaagttgtttatcagatcaaggagctttttggtagagtctatggggttctctaggtatagaatcattttctctgcaaagggatagtttgacttcatctcttcccatttggatgctttttctttccttctctagtctgattgctctagtacttctagtactagattgctctaggactagattgcttctagtactagattgctctaggacttctagtactatgttgaatatgagtggtgagagagggcatccttgttttgtgccagttttcattgggaatactttcagcttttgcccattcagtatgatgttggttataggtttgtcatagatggctcctactattttgaagtatttccttcatggcctagtgtgttgagggcttttcatatgaagagatgttgaattttatcaaaagccttttctgcatatattgagataatcacgtggttcttgtttttagttctatttatgtgatggtgtgttagtctgttctcatgttgctaataaagacatatctgagactgggtaatttataaagaaaaagaggtttaatagactcgcagtttcacatggctagggaggcaaacgaggtgtttgcctcatggtggaaggcagacaaggagcaaagtcacaatttatgtcttacatggaggcaggcaagagagtgtgtgcaggggaactcccctttataaaaccatcatatctcatgagacttacgcagtatcatgagaacagcacatggaaagacccccatgaccgcaattacctcccaccaggtccctcccatgacacatgggaattatgagagctataattcaagatgaaatttgagtggggatatagccaaatcatatcagatggacacgtttgttgatttgagtacgctgaactaccttgcaacccaggaataaagcctactttatcatgatgtatttgctttttgatgtgctgctggattcagtttgctagtattttgttgaaaactttttgtatctctgttcatcaaaaatattagcctgaagtttatgttgttattattattgtgtggagattttgatttaaagtctgtttcatcggaaattataatagcaatgtctgctttttttctgtttgctgtttgcttggcagatttttctacatccttttactttgagtctctgggtatcgctgcacacgagatgggtctcctgaagacagtataccattgggttttgcttctttatccaacttggcactctgtgccttttaatttgggcatttagcctatttacattcaaagttagtattgatatatgcagatacattcctgtcatcatattcttgtttataggcactaaagcacagctgctgatgtatttttctcttccttcttcctcttctgtcattagcctggcaaaatatgcaatttttatgtgttttgttgaaggttcaaatgcctgagaaatgcaccatttcaaactagataattttatttcctgaggagaagcaaaagtgaaaaaaatgcctttcctttctacattgtgccagcaagacttagcacatgcctaatgtatagtaggtgctcaatcaatatctgttgaatgacaattcaaattggcaaaatatcacatggtgtgggaggataggatataaaaatagttggtttatccttaaacttaactaatgtgatttaaggaggagattaatccatgcatggtatattagttaagcaaatggagtggtgtcccagtgtcagagaaatactgaggttaattcctcactcccccaaaggtgtattcagcacaggtgatttaatagctcaaagattgcttttcacttctcctctagggagagtacaataaaatgaattttaagttgcttctgaagaatttatagacttaatatctgagtcttctgatgcaacctattttctctcttttactgggaaagtggtataatatgcatttttataaacttgtacaagatgatgggttcctaattattggtaatacccttggagacacacttgtggtctgtcctttaggacatctgcaccagcactgtttcaatccaaaaggtttacacagctctgaaatggacatccgcaggcagccttctgaagtgaaacaaagactatttgcatgttagacaaagcttattcagtaggaatcaagatggatggtggaactaaagaacactaagatacatactagaacgtagaaattaaagtagatacaagaacgtggaggaggaacagttgacattttttagaataaattaaatgagagttaaaatcatcactatgcaaagctgcagattgagaaggcatttggccaatgtctgaacaatgacaaagagtatgggtgatttgaaaattgctaattttgtcaaattttggcacatagaggattatattggtaatagctaatattttgagtgttgactatatgccagatatgctaagcattttatagagagttttataagtcttacaacaatgcaaggagtatggcatcattgggtcttttaaaacttttaaagaaaaaatagagaataatcaaagtgaagttctattttcataacatatatatctatattataaaagaattatagtcctgatcatccaaaagagccaatagatatttaaagaatattgtagtcatagatcatctttattttttttaaaaaatgtcacttgctatattgtctttatgttaagactaattgaagagggcacaaagtcaaagctaattaacaacatccaatatgtcagtataagaatactgttatttatatttttgtcaaaaagaaaacatctaactaatttaaggtatattttacagtacagttttacaaagcatatcatcaaatgactaatttatatacttatcatcaaatcactaatttatatatttaaaaagtaaatttatttgtgcaggaaaatcaaatagttccccaatgtattgatacgatgactgaagcttgcatgttatcatggtattttattcttctgatatatctcttgcagaacagaattagtaaataaaatgcatatttcactttaaaatttttaaaaagttgattatttttctaacttcctctgaaacatcagtcattccaatattcaattaaatttttggttaagatagcctgtaaaatcaatatgaaatacattttgctgtttggtaactaggttctagacaattagaaaactatatcaataagataatatcatattttttattttagaaaaggctcaggcaactgttagaccttattaatgacaatgactcaatgtaatgaaaacaaatcacagagatctgctagatttacaagaatacacttgccatacataacactttatgagatggggtgtgggtttaatatcaataaagagaagaagaaaagatattaaatgagactttgataagctggaatctactaatcaaaattctcaatgacattttcttctaacgttctttaaagaagaatcaattcccgcaaatataccaaaaaaagatactagagataaactcacaaaaacaccacaaaattagtaattatgacagaactattctcctatagaacatttcagggggaaaatcctacaacaaatgatacatgaacaagtgtccaagagtgtgcttttcacagtggggtctgttctatagacccccgccaataaaattccattatttcagcattttatctggacttcttgaattattgaattattccatgcatgctgaaaaaaataattgaagcttcagttttctctatatttacaaacatttaactgacatacatataaatacatgactataagaatgtatagacagcacttgtgtgcaatctgctgtatggcttctgtgaatgtcactggagaagactccttatggcacagatttattcattcccacagtttttatttcattttggcagaagattactcagagttttagggtttgtccaatcagcttttaactaagcccagcatacaatgccaataatgaattccctacctaaacccaactaactatgtgaatgctccagatgttcttagctcaaacatctgttgcttaaggcaggggggaggttctgcattgtaccatacctgagttacttgctacatttacatacttcatatgggaggctaattcaatccactgaattttaatataggtcactgtacagaggtcaccaatcatgatagaataataaaatagtgataatttaatgataaaccagtaaaatgaagtaattatgaactaagaagaactccaaaagaaaatcactttactcaatctcagtttgctatggcaagtagtatatatattttattaaatgttttctactgaataattacaatattataaatacaatagtcataccatggtcccagtaacactgacaaggcctttgaaggacttggagagataaagtctgggctccaggaccacacccgtactttgggccagatcatctaggcttctattcacatagtcagttatttatttgacatattgttctgcactttttgttggaataaagaattccaaggctaactacatatagcctagctccctcattttacagatgagcaaaaagagaccagagaaaataagtccgatcaaccagattaaataatacagtaaatgaaaacttggattagaatctagttttcctaattatctagtactctatgccctgcacaatactccctcctttatgtcaaaacatccctactataaacccatgtgtatatggcaaatccaaattggtggcaagtcagtatcagattcgtttcaaaagaaatgcatgcagttttattgttcagttagctagcagttgggaattacatcagcaaacatatgcttaaatgtacacaatagggtactaatttaatacatataataattttagaaagaatgaatgaatcgggtatgatcaagccacataagagaatcagttccattgtatcatagccatcaacataaataaatgtaaatttcttgtcaatgtgattataaaacacaaactctgaaaatgtttttagttaatatatttcaatttcttttttacaaaccaaggcttttacattttctcagtaatattttctttatagataatgaaaggcaaatttcattctggttcttgccaaataaccgctaattataaatgtatagtatttgaataaagtgattttattatttccaagaatacctttttctagtctcatccattcacattcatggtatgcacacaacaaatttgtcacattatgctgttagctgaggtcacaactttaaactctgagactactaaggtgaataaacattttcataaagagtgtgacatttgagtcactggagtcagtgaagaagagaaatggcttggaagcttccttggctatgctgacaaaaaatacaagatacaatgccaggtgcaacaattatctattgctgtataacaagttaccctgaaacttagcagtttaaaagaatactttattatttcttacactttctgataatcaggaatcaaggagattagctgggtccttctggcccaggatctcttctgacagagtcagtacagaagtcagataggaatgcttcatctgaagggctggaggatccactttcagcttttcatgtgtgtattggcaggaggcttcagtggctctgcattgggcagctcatacataacagcaggcccctcccagaacaagtgatccaagaaagaacccaagatagaaggtgacctaatctcataagtgacatatcataacttctaacatattttattggtaacacaggccaaccttggcactatgtaagagggaatttattagggttagaatactacaaagtagtaccattgggagatgtctaccacaccaaatgaaaaagcaacatgttaacacatccaattttgatcatctacaagatatgccaagctggagttaaactgatagaagattgaaagtagagtcccatgtgttgatacagaatggctaagatgttaaagagctcttgaggtagggaattaaaaacacatatgacactttgggaggccgaggagggcggatcaccaggtcaggagatcgagaccatactggctaatacggtgaaaccccgtctctactaaaaatataaaaaattagcgggcgtggtgtcaggtgcctgtagtcccagctacttggggggctgaggtaggagaatggcgtgaacctgggaggtggagcttgcagtgagccgaatcgcgctactgcactccagcctgggccacagagcgagactccgtctcaaaaaaaaaaaaacaaaacaaacaaaaaaagaaaaacaaacaacaacaacaaaaacaacaaaacacctgagttaaattgcagctctactatttacagtgagtgatattaactactcagaactccagtttctttatcataaaattggaatcagttatgtatactttggagttagtaaaaattaaatgagatgatgtacacgtcaggtttcttaacatatagtaagcacaattattaaagtaaaggaacaagtagaaaaaggaatatactctttaatttggtctacaatagtgactaatatgtttctactagccctagctatagaaagagtatggatttaaattatgtctcttttcataacaacccctgtgactataattatggacagctataaattgcctaataagataggaatacccttagactcaacaaatctttcttttgtcaaaagaaaatttataaatcttatagaactcaaaaatatattccaagggatgatctgtatgcattctcactcgtgattatatttttaataagcactatttcaatttaataatatgattatcttgtttattttcaagtaccaatagcccattaaaatttcactggaaggtcactaagaaatattttccttatgaattttagtgtaagtttctctctttcagagaagtgataagtaagcttaatataatggctcccaaaatctctctcaaatacaattccatatacatattagagtggctgtagagcacatatgatgaaaacaaatttcacattaaaaaaataatattattggggatatgtaatgggccaaatgataccttaaccttcaaattaaatgtatagagttatttaatattttctagtaagtttttatcttttagcaaaagagaaaaatgaagtgtaatgaatgatgggttaaaacggcaaagactgtaaattaatgttatttttgagaaaaattgtcaaattcaaatctccctttttatttaaacagagttctgtttttatttccatgaagttattccaactgcgctgtatcatgatgtaagtagagtgatacagtgcaaatggttcagagacactgaagattccctccagaattaagaaatgatggccagctaaccaacaggatattatttttataattgtagtagcagcattttaaaatagctagctaatgattttatgtgatataaatgctagttcacagacgaagacaaacttcctggaacagatgatattgaaggagactggcaggaaggtacgaagaaacataaaacactaacatttgataaaatattatatagaatagtacataatatacattatattagtcatattgtatgtaattataaaaatataacaaaaatatattattaaatatcatatataatatataatgataatattatataatgtattatatagtatcatataatgtaatgtactattattatataacatatatagataaaggatcaacctcaatttggagtaaaagttgagaattttttcaaataataaagatagaaacttagatcaaaaagttcaagcatcactaaaggtccaagactgtcagaaaccaaacatttgttttagtttatcttcactgattactatacttgaggaaatcaagtttaccttcaattagtccttatataggaacaaattcaattagaatgtagaactcccagggtaagataataatgcctacaacactgcctggcaaagaacagtcaagaaatatttgttgactgacagaatgaaagagtgaataatttcccccctagaataacattatgtctgcttaatacttatatttaaattatattcatagctgcttcttccttcataaccaagaaactcatgcccctcttgtgactacccactaatactcagaaatatgacacacattttcaaataagtctgatatacttaggtaggccactgtgttcttgctctcccccagggtgaagtgagctgctgttttccttgctaaccctgactagttcacatcaaactccctgtgctgctgcgtgttgctctgttttgtctacctcaagcatttattgctcactgccaactgctgtgttgttctgcccaaaccacttacttgttgtgtactgacttaaacatttgctcacaggcactttagttcctggtgctgtagctattctgtaaaatagcaaaatagcactctcttctgtcttcaaccctggtagaaactatcacaacataggaaactcagcctcatttagcttttcactttaccaagaacagaaccccaaatctttctatggtttacaagacccattgggatttggctggctcctacacatcttctaacattatttttgttcttctctctcactccactccagccacaccagccaatattgcacttgctgtttcttccttctggattattctttttccagatattagcataacttcttccttcatttccttgagttttctgattaaatgtcatctttttggggatggcatataggaactattctatttttgaaagatctgcttgacccaggttacagtattctgtttccttgctttaaattttgtaacatagtttgtgctgcttgacatattttatagctgtttaatttgtttatgttctatttttttctgagaaaaacagacaactatgaggaaaagactttgttttattatcaatatatttgccattagatcaaagcatataagaatagctactcgagacagaaaacatgaaaggaagaaatgaaggagggagggaagcaaagaaggagcgagagaaggaaggaaggaaagaaggaaggaagggagggagggagggagggaagatatataaatagattgatactatttaatacatcctaatctcaagaaaacaagtggaggcaaattgatcctgtggtatgggaaggggtgttataccttgcacatgcaatactctaccaaatctttttcagtccagcctggacaccatatacttaaaactgaacaacaactcttgtgatacgattaatatgcttgaaatatttttattttatcactgacatgtggattaagaaattaaaataattaagaaaaatcttctttaaatgaaatatttggaatagaaagctagaatctcaggttccccgagtctggtaactgtttattatggctatggatgcagtaaagctctagctcttgatttattaattaatggagtgctcaatatatgtttctcaacaataggtaacatgagaattgaagaagacaggagacattaactttaagaaaacccttaatgctcaacaaattctgcaaggttaatgtatgctgttttacaggaatatcacaactaaaatattttaatattattttttcccttgcaacaataaagaattctcatgcaaagtctttatttaacttgtctgttgtttgtctgttgtgtccttttaactttatttatgtattttatctaggcttgatctgtcagacataagctgtttgataatttatcatattattattgaagcaagttgtcaaaccagttaaattcatgtgaaaaggaattcaaattagggcaacaaatcttcaaagtccagctgaactgctaaagtagacaaattccttttcttctgttttccccagatgctttttacattcactgatttttcttcccttttgtaaatggaggagaaaggaagaattctgttaaggcaggagtctgagacaagataccaacatatctagaggcaaagccagcatttctgttctcaaccataagaacatacgaaattatgtttgattaatttcaggaggtggaaactgagggcctgctggctctaaatctggcttgctgaagctttttcctttggaacacattgttttttaaaagcaataattatataaaatgatatataagtatatatattaaataatataaaacgtgcatatgcatatctatttgtacatatagatgcatctataggtatgtgtatatatatgtaaggtagttaccatatataaaatataatggcatttacaataaaaaacatctgaatattcagctgttcttgatgactctaggtatcattaggcatacatttccacatgataatcattagataaaactgagaagtaggcacattccttggacagagtatgctttaccaattcaccaaagtcatgggctgccttttatcttacatttggtctaattcatacatctatattatgagaatggcttctgtaggcatgtcagtttgctatcaatttttaatcagtttgattaggctagagaatatttgggtaacagcttttggttgaattggtagttttcttcaagagctagtttaacttgatagccccaatttgtcatgtacctaactttttctatatccagtacaatttatatattaaatagcatttttagagaattaagttttcttgttatgcttgacacatagttacaggggaattttgccttcgaaagttggtgtaagatttttctttcccatcatgttaaatgaaacatgatagacaatattaaattgttttttgataaccaggagtttttagataaccataatatattcaattgtagtatgctacgaagaggcatatacagggcactggattggactgaacctgcattaattccatagccaagaattattttggctaacataaattttagaataactatcaggtactttctccatttttcttgctatttgaacttttgtacatcaaattttaggaaagtaaatgaaaaaatacattatctaaaggttttgattagttctattttaatgacatggaaggtgagtcacaggtgtttggttggttgtttatttcatacagatttaactctcctctccaacaggttttcctaagtcccctaagtaaatgtaattttacaattaaaagatttatagaaaaaagatgcgttaactcatccattatctctatatagataagcatttttaggaaagtgtaggcttaattttccataagttttttgcaatgagaataatcagcaatgaaataaactagcaaatacaacacatttatgttagggctgacattacttttggtgaattgtgaaatatgcaacttctgactttcttccctcaagttaaaacataatttaatatttttctctaattgtgttccaaatagaaactgacaaatagttaatttaatctagaaggctattttgttacaattttaaagatttttcttattactggtaataaagacaaatagaatcaatatttataaaacaaaacgtctatggtttatgaaagaaaagccacacatttctaagtttttcagtcaaggatttcatcatcctgatctgccataatgagtaatacaaagttatgaacccaaagcagctacacataagaaatgtactacacagagaaatgtgttgcaaagcaaggagcttttgttttctatttgcataatttaaaagattaactgtaaaaataataaaatctcttgttcaattcatcataatttcatcctttctgctacacttttggcaggtttttataatatgaaggtgtactttactgctttcttaatatctaaatgctctgtcaaataatcaagtgagttcagtaagaggctattaaaaacaaagttaattactaatctgtcacagtctttatttaaatgaatttataaatgaatttaaattagttttgaaagcatcatttcagaatataagcagacagccagtgagtatttacatttcaaagaagtatctactagttagaaaataattgcctgaggaatcaaaatatcttagtatttggcaccaaaattcaactatttttaataaaaatattattgtttagaatctttatgtagttaaaatgagcagtatttcaattatgtcgtatattgaagttatagtcacaaaaacccttagtatgctttacatctttggctgagccttgtctgattcttgtacttgtccttatccttgtttttttctgaatctcttatgggatcttatgtttgtcatatgaaatccattctcttaggctaagttcatcttcttatataacaagatattcttaaatatgaatctataacccagcatactagccacttcttttttgctttttgttggctgcatctttggtgacttcaaccaggttattatttttactttattcttttctttttttctttttctttcttttattattattattattatactttaagatttagggtacatgtgcacaatgtgcaggttagctacatgtgccatgctggtgtgctgcacccattaggggaggagccaagatggccgaataggaacagctccagtctacaagctcccagcctgagcaatgcagaagacggataatttctgcatttccatctgaggtaccaggttcatctcactagggagtgccagacagtgggcgcaggacagtgggtgcagcgcaccgtgcgtgagccgaaacagggcgaggcattgcctcacttgggaagtgcaaggggtcagggagttccctttcctagtcaaagaaaggggtgacagatggcacctggaaaatcgggtcactcccacccgaatactgcacttttctgacgggcttagaaaacggcgcaccaggagattatatcccgcacctggctcggagggtcctacgcccaggtagtctcactgattgctagcacagcagtatgagatcaaactgcaaggcggcagtgaggctaggggaggggcacctgccattgcccaggcttgcttaggtcaacaaagcagcccccaggcttgaactgggtggagcccaccacagctcaaggaggcctgcctgcctctgtaggctccacctctgggggcagggcacagacaaacaaaaagacagtagtaacctctgcagacctaaatgtccctgtctgacagctttgaagagagcagtggttctcccagcatgcagctggagatctgagaatgggcagactgcctcctcaagtgggtccctgacccctgacacccgagcagcctaactgggaggcaccccccagtaggggcagactgacacctcacatggccgggtactcctctgagacaaaacttccagaggaaggatcagacagcagcattcacggttcatgaaaatccactgttctgcagacaccgctgctgatacccaggcaaacagggtctggagtggccctctagcaaactccaacagacctgcagctgagggtcctgtctgttagaaggaaaactaacaaacacaaaggacatgcacaccaaaaacccatctgtacatcaccatcatcaaagaacaaaagtagataaaaccacaaagatggggaaaaaacagagcagaaaaactggaaactctaaaaagcagagcatctctcctcctccaaaggaacgcagttcctcaccagcaacagaacaaagctggacagagaatgactttgacgagttgagagaataaggcttcagatgatcaaactactctgagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactatgtgaagaatgcagaagcctcaggagccaatgcgatcaactggaagaaagggtatgagtgacggaagatcaaatgaatgaaatgaagcaagaagggaagtttagacatgaagaataaaaagaaacgaacaaagcctccaagaaatatgggactatgtgaaaagaccaaatctacatctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactctaagacatataattgtcagattcaccaaagttgaaatgaaggaaaaaatgttaagggcagccagagagaaaggtccggttaccctcaaagggaagcccatcagactaacagtggatctctcagcagaaactctacaagtcagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaactggtaccagccgctgcaaaatcattccaaaatgtaaagaccatcgagactaggaagaaactgcatcaactaacgagcaaaataaccagctaacatcataatgacaggatcaaattcacacataacaatattaactttaaatgtaaatggacttaacgctccaattaaaagacagactggcaaattggataaagagtcaagacccatcagtgtgctgtattcaggaaacccatctcacgtgcagagacacacatatgctcaaaataaaaggatggaggaaggtctaccaagcaaatggaaaacaaaaaaaggcaggggttgcaatcctagtctcttttttttctttttgagaccaggtgcggctctgtcacttagggtgaaatgatgcagtggtgtgatcttggctcactgtaaccacagcctccccagctccagttatcctcctacttaagcctcttgagtagctgagactacaggcatgtgccaccacattctctagctattcaaagtttttatagagacaaggtcttactatattgcccagcctggtctcaaactcctgagctcaagtgatcctcctgtcttggcctatcaaagtgctgcgattacaggcatgagccactcacccggcccaggttattattaatatgttgaaaataactccgatctgaagacaggatcctaaagatgtcctcttacatatcttcatctttgttgatctcaatttatcaatctgtactttaggatctggggagagaaaacattcgctcaacctgttattaacttaactcagttctatagtgtgttagtccaaatatttcatatcagaaagcaccttgtagaaacatttgtataagtacatatgctagtcctaaggttcacctcaaaaagggggaggtgtttggtatatgtccttagcaaggtttgcaacaagatttttcccctcataatatcatatgtatatattttatgatatatatatatatatgagacagagaaagaaaggctaatctgttatgacttgtttcattaaactagagctttctctgaccacgcaacacaaaagagaacattttttgattcactgctatatgttttttataaattacaaagatattatggtaaattccaaacttttcctacataagttttataattaccaaattataatgataattatctcatatataatttattttataatttggtacagaatctcactttgtaaattcatacatcattttcatattccatggaaaaacagttctttcatcattttaattgcttattaaagatcctgtgcaatcagtccatcatttttctctaatatatgaccatcttaaggtgcaattcacataagccaggggattgagctcatttggaataccaaagtattgtctcggagttcaatttctctggactttattccagtttattcagtttaaaatatttcaccttgacagaagacattattaaacaagaagaaaagtattccactaacattctgtcatttatgtggatcccaaatggagggtttattcacttcctggtccttgctccaagtattactaaatgccattaatgtttctctcattctaaatgttctttgaaactaacattttgtctagtattctgcaggtggtagcaaaataaaaacaaagttttacattcaaatactattggtttctttagccacgtttatgcattattaactttttctttttctgccattgttctgttaatatttctaggtatacagtacatctgcttgtactctcagctacctgaaattattctatttttgaaatgacaggaatatataccaatacattgatagggaatatcaactctaactcacacacaaatacaactattaataatagcttttgtgtactgacttgagaagtataataaaaattgttggtcaggcatggtggctcacgcctgtaatcccagcactttgagaggccgaggccaatggatcacttgaggtcaggaatttgagaccagcctggccaacatgggaaaatcctgtttttactaaaaatacaaaagttagccagctgtggtggcccgtgcctgtagtcccagttactcgggaggctgaggcatgagaattgcttgagcccacgaggttgcagtgagccaagatcacaccactgcactccagcctgggcgatggagtgacctgtctgaaataaaatcgttttatttagttggcatatataagcacctttatttacctcaaaattctgtgaagtaattatgattatcatccccacattacagataaagtaaccaaggtacaaatatgttaagtcagttgtccaaggtcacatagctagcataagagaaccagtagaggaatctaaataatctagttccaggacttgattatgctaaccacttcacaataccacttctcatattttgtttaactttacttgcatgcttcttatcagattttgatcacttaactctaaccaacaaattcagtttttgttgaagtagattctcatcatttcttctatgctttttactgtcaactaggcatgccaagagctcatcagtcgtctgctttaaggagattagatgtcccatctcttttccagttctaaggtgtgccctaaacctgcctccattttactacttttggaccttctagtatgctgttaataacacttcttcattaatgtttcttttttttttctttataccgctttatttcaaccttcccagcatgctagatttccatgtagtgtgtacccatatgacacctggtcttctccagttaggtcaatttctttcttaaaaaatgtatctcaataataaattctagcccccaaaattttatgatttcctttagaatatgtatcattctgccatacctatgcataagaatattgaaattgtaagaacataagttggttttttttctttttttgagacggagtctcacactctgtcccccaggctggagtgcggtgatctcggctcactgcaagctctgcctccagggttcacgccattctcccgcctcagcctcccgagtacgtgggactgcaggtgcctgccaccacgtccggctaatttttgtatttttagaagagacgaggtttcaccatgttagccaggatggtctcaatctcctgacctcgtgatacgcctgcctcggcctcccaaaatgctgggattacaggcgtgagccaccgcgcccagccgaacataagttttatttgtggttatctttcaaagtgttgcctcaagagaggttttgataagcttcatattatttctgtttatttcagtagctaacttatcaactgattaaagataaactcccatttttaaataaaaacaatgaaactgaagcaaagtttgattttacccaatcatctggaccttaatatatcagtatatgatttctatattcatacattgatggaaaatagaaggtagtacaagtaaggagactgtggtcttagttccagttctgtcaccagctttctgattgagttttatagataatttgaatgtctctttcctaattcataatttattcacaatcttggtgattatatataaagtacttttaaaaagtgtttttgacactatgattaatgagttatttattaatcaatacagacaatttgcttcacatggttgtgaacagataccacaaaactgctagacaaataaataagcaaaataaataataatgaattgcaggtactaaatattagatatgtgggagcagttcctgtataggaattattgtaatagtagttggtagaattacatccataaacttatattgtttacttcctggacaagaaataaaagatcttaataagaatgtagctcaggaaaataaatagtgttaggatctcaaacaacacatggttatgataaaggttataagttttatctcctttgcaagaaatagggcaggcttcagtaccacctagtgacaatggtgaatggtctcaatggcaaaaaacagcctggaggagaaaagacaatctgcttttattgtattagctatttggcttctatctcctacttctattccttttttcattcttctgtaagataatgtgtttatcctacttttggtttcttcaaattttgcaataatttaattcctgtacaacactaaatcaccatggaaattaccctgttcatacaatgaatttgaatacaaattaaatgatcgagaaatacattcaaaaactttagagcatgacagtctcataaatatttgtatataaactgtctctacatctctcatttatagggtttctattttaacatgatcctttgtataaaaatctgtatttatttacatttctttttaatatttttcaaaagagctacttattaaaaagttctgatctcttggtataatcagaacagaaaaatatagagaaataataacactgatgaatgtaagggaaaggtgcccctcaggagaatgatttccattaaatgttacagattactacattttggtttgatttgcctaatatttactgatttcaggcacatggtaaatttcttttctcttctttttccttaagaattgataactcagtcgaggacagaattacaaaagttgtagactaaatgtaatcataaataaatggcacattaatgcttacttttagcttgggagcaatggggagataataatgcccaccatggaaatgatacctttttctattatattataatttcattgaactcagtaaaaatcttttttttaaaaaagtgaataaatagctgaccttaggaaaaacacaacatcaattaaaaaaatctgaaaagtcacctaaaggccaaaaacatagtttctggaaaattaagaaggtcaaattcaattatatccacatttggtatgtagttaaaattcaacatatttccactagaagcccttccccatgttgtaggaatcaggattttagattatcacattgatcacagtagcaaagggtagcacacagtgatctctaaatacacatcatttgctttgatggacattataagtagatattataaataatattcattctatatttagaatataattagagaccattttaattgactttatgatatgctcaagaaaacgctactggagtatagagaatggattgtgattcactgctatatgttttttgtaaaatacaaagatatggtaaattccaaactttccctacacaatttttatcattaccaagcttatgcatgagaataaatgataacagtccacagctaggtgtgcctatttctctatgcatgaaatatgagatactggatgtagaacagagacaggtattgattaactcttatttggattggagctgtgtttctgaggcacctagctggtaaatactagaagggtatttagttttttttttttgtttttttttttaggttccagggtacatatgcaggtttgctatacaggaaaattgcaagtcacaggggtttgatatagagattttttttttgtcacgcaggtagtaagtatagtacccagaataaattacatctctaaaaacagcaaacacttctaaaaaatgatggggtatataagatagtaagatagaacccaataggtagttttcctatcctctccctctcccaccctccaccctcaagtaggcctcactgtctgttgttccctaaaagagtatttaaatgttaatcataatggccctatgtctagaccctcaaagtttaaagaaaatgggccaattagtctattctatattttaagatctcatttaataaattgcttacagtggttgatacattataagaatatatgtataaaatagctgaaataagttaaaggtttaaaagccaaattcatcataaaatttactcattactccagaataaattacatctctaaaaacaacaaacacttcaaaaaaaatgatgggttatacaatggggttacgaaatgttcgttttaggtttcaaaaagtgtccctcctattctttcttatatcccgcatttatcacatggctttcttcatgtcacttctgattctgtcatatatctctagagtagcataattagactggggtataaagcaggagggataaaaatgagatggaatagaaaaagcaaagtgtggagagcctttcattatgggaagcaactatataatcttgtctggaaaattatctgaaaataggcaacttagcttacataatttaagtctatataagtctcttttaaacagagaatgataaccttgaactctttagaaagagaaagttcatatgaattgcctgacatccgtatatccgtaaattgaataatacagtagaaactattagtctgctattccactgattcccagattgaagacaatgttactattttattccaatctgcatcaattcaaaacaacatttttatgtgaaacgtaaatatatgaggagttcagaaaaaataagatattataattgcctttctttgccagattcttttgaatttacgacagtagtaaaaggaaagaccctaaaacccaacacacacatacaaaacacaatgacttttcacgtatttttcatatacattctgagctcttccagcagtgcagccaattcatggttgttttctataaacataaattggcaatggtttataaaagatgaagttgtctggggctcatgaagtagaatggtatggtgggttcatccttaatccaaggggaaatatggattttataaccagctaccatactgtctctggctttatgcaaatggaataacaattctgtttcagactctttatctttaaaatggtaaatgtatttttactcatttccttcaaaataggtgagataatgtgttatacatacatgaatactatatttgtgaatgtctcaacaacatttagaatagcaaggatataacggagaactaagtctagcaaattaatcattttggaggaaatattagacagcaaaatacttttttttcttcaactttatcaggtgccacttgttagataaggtaatttcatgaatagtgcttcttctgctatttgttgcttaaaatttaagagccagtctatgtaagcgggaacaaaaacatgtttggaacttaacggcttggtcttacattgctaaagcaactcaaggtcaccatagccaatatacaatctcatcaatatcctgtatccctctcgatgatgaaattatagttcgatttaaaattttctgaaatacacattttatctgaaaacaaaatatcagattagagttgatttccttatttttttcctgtaagagaatccacatctgagaaggaagaacacagtatgtgaaccctttcccttttgtgatgaggtcatgtttctatccaatagagagcagttgccaggcagactttgctaattgggagagacaggacagcaaaggagaatcgcaacactcagcaggctgctgacctactttattattataactcataggagctacgaaggcatttttttttccagtagagctacagtgacttgtcagcaaattagttaccctttgttaggtcttaaaaaaaaataaaaaaaaataaaaaaaaataaaatctttctgttatggcagtacgttctattttaaaaaattaatattatcagaataatacaatttctaagccatagaaattcaaatctaaaatagattactgaatctcaagagaggggaaatatatttttaattaagagattttttagctcatttcttcgtaatattactttggctatattatgtcaatcagtcattacctaagtagttaaatgggctctgtaaacaaaaagtgaatctattttaattttgcccttaaatatttgatagaatggcaatagataaaataattgtccgggtttctatattctaattgtatatgtgagcttacatatgaataattctcattgctttttttccaaattatttacttaaaatatcaataaatagctctctcttctctgcccacccagcacacatttattgggatgattatagtttttgagctagaagtgcctgaagtatcttgattccccactctattgaaggttcctgatctaaagccagctaatactacttgaaatgaatgtctctctattttgtgtctccctggccctcggtttttcatagattttatttcaatccacacagggctactactagaacaccactggatgagttagaaaacagactgtactccctgggtatctaaattaagaagagaaaataggcttgcatggcttcattttcaagggaacacagtttggaaaacagaaaaaaggggagtaattcaccagcacttgaaccatgctctttgggcagtgcaaacatttcagagctctcaattcaaattcctattaatagatatgtcatataatttaccatttcactggattataaatgtattcattgttgagcttacattttgtcaagttttatatagtttttagtacccagaaaagatagtttgaataaaagcatgttagaatgtaagcctaatgagggcagggactttgtctcatcctctaccatgtgtttagtgcctagaataatgtctggaacaaagaaatactcaatagatcatttaaatgaaaaaatacataatatacacttaattcatagctaagaagctacgtacaagaaagtcaagtgacttgcataaaatcagcagatttaggggttgaggtaattccgatatgtatgtctttaaatttaattctgcaaatttcgccccctatgtttctgtacaaacgagttaggataggctatgttatgtgtgagcttcaaattaagacatgcttctggaactcaaaaaaaaaaaaaaaaaaaaaagggttgagggcattatagcagcttttcaatgcttatacctataagtgaaatatactgctattcataggccattaattattaattaatagcacagacaggtacccatctaactgaaaggcagctagaaaatatggaaagcacgtggctatttggttgttagtaagtgtccctgtcacattgtttcaaataaaagtaaaatagagtaacctagattttccagtggaatcccttattctctccatatagattttactaattagaccattacagacattttttatatcagtttttttctctgatattgctagattggtttacgcatcttaactttttggaaattaatatatctatagatatgtagagaattagaggcttattaattttgacttcagcaatttagagtatgtccacgagttctaaattcagtaatttagagtatggtcaagtgattgattacttatctttgaaaaaaataacttgagatgcacaaatcattaaaacaaaaactgtataaggaagaccacttaaatagataactgaataattagtttgcacatattttaaaaaatgctgataattaccattttgattataaacaatattttagttagcaacacatgcagagttggtataggagttgtctaggatgcagatacatgaaagaccaattgtctgcactgtagaatagcacttatcaaaattaaataatgcacagattccttcaaatcacaacaaatgaatcattacaatgaaatacccttgacttgggttaaattattttgattataatgttactcaaataaatacaagtataaaactaaaacaaacataattttacaaatcaaatacaaaataatgaatcaacaaatacatcttaatgtaaatttactgtgatgagtaatgctgttttgctaaaaccaagtaggtgcataaaatgtaaatgtagtgctgtaatgccaggttttgtagattgtgtgattttatacagtattctacaactgagtgctatggaatgactaattgacttatccaagtttttcttcattttgactacggtgaaacgtgtacaggatttaatatgttattaatctttcaattggtataaatgcatcatttatttgttatgctcaaaaaccagaattatttgatgtaactcctcatgacacaacctgctccaactacaaaagcatattcagattccatatgtatgacattcagataatcctaaattcataacatgctatgttaaaaccttcaaaatgattactaacatgtaatcatatatttataagattgctagtagaaaacatggactccctgacagtaaacctatagacttttaaagaaagattgctctaggaatgtactgtttagctgaaaatccttctttatctgttctataaagtcattccctaggttacatccgatatttgagattcagttcaaaattaatacgcaagttaacgtgcatcatttattttcttatattcttaaaatgaatatttcatacttgtaattttaacaaaaacccattactcccaatcttgtttataatgatttaatataattttagtgttgtacacctaaacacatagccacaaaatgtcatgggaataaaactaatcttattagaaagtaattatctgctatatccaagattttcattcagatagaattatataattcagacttatttcttgaatgaaacaaaaacaaataatataaatacaaagcaaagttacttcctgttcacgttgtgttttgcaagtcagtatctccttcctagtcaatttaagtagcctgcacttttagtccgctttccgttgttacaacaaaataccacagactgggtaatttataatgaacagaaatttatttagctcacagtcctggaggctgggatatccaagatcttttaaagtttcatgtggtgagggcctttcggctgtcccctaccacggcataaggatagaagggtgaaagggccagcaatcacatgtgaaagagagctggagatagccaaacttatatttataactaacccccttctccaataacaatattaacctgttcatgaggtcagtctgctctttatgtaatcacctcttactagactttgcatcccaacacttctgcagtggggattaggttttcaacacatgaagttagggggatacatttaaaccatagcacctgcgacggttagtgattgactttttaaaaataatatttaaataaaaactttaatgaggaatttagaaagactgcaaaggaattcactgagagagattgaacctacatttatggaatgaaatagttaatataagaatagatatattaaacaaattatcaacactacagttacagatacagtataattatagcattgactttgagtttctcctcatctagctagtgggatacagataaaagtatgggtataagtgcagatacagttaagaaggatataaatatatagtaattaatatttaagaataaaaataatttaatgatggaaggatacaatgaagaagaataaacataaagaatttgttagacccactaatctttattataaataatttagaatcagagcctaaggtcatagcatgtttgtcaagcccaaacccaagaaagacgagtgcattcctgcatatatcctggcctggctccttaattttttgatttctcaacttgattttggttttctacatctcacaaaagatcaatcttgccactttttagtgtcagagctcaaacgttaattttaatgggattttctactgcagttggagtgctttaactaacaggttttgtctctttattactaccttccttaactgttctttataatctatgctgcacaaaaccgtccaacatggtttagagcagaaattacagagtcagatatataagcattctactcttggttctataatctagctgtgtgacattgactattcatttaacttctaaaaactttagtttttctagccaaaaagtggggcaaaataatgtttacctcattcagttgctgtgaggaccaaataagatagcatccttcaaagcacagagttttgtatatagtaagtgtattaaataaatgcagggtgcttttgttctcatattggatttgcacttctccattataactccttgtgcataaatatactttgctttttattattgcaataaatgatttaccaaaactccataactttagaatggaaaaatagtatcttcaaggtcaaatgataccatcaagattctctcttgattcaaaaatggtcttttttatggttatttccttcacatcactattatccacaatataaattaggccaggcatgatggctcatgcctgtaatcccaacacactgggaggccaaggtgggaggatcacatgactccaggagtttaagaccagccttggcgacatagcaagacccccatctcaaaaaataaaaacaataaaataaaataaaataaaataagttatggcttttatatttgaacatacatgacggtttccttctctctacattcgagttacacatggaaaaatgttaaataaacacaagagaaaataaaaaccaacttcatatgtaaatctgcagccaaaaaaaaaaaaaagccaagaagtgaattgcaaattctggaaagatattttgtataatgtcaggatattaaaaaaggttgaaggttgggctatgttggaataaacatactacacacacacacaccacaaacacacacatgaacacacacatttgagcacatatagacatgtttaaagaaaaacaagaatttttttcaataaatgtgtttatcatcagatatattaagtagtatattgccttataattatactaccatatgtactttatagacatcccaaaatagttattttactatatctatgatgacaattggtatttttctgaaagatacataggaaaaatgtaaaataataattttttaccaaattaaatattggttggtgccaatgaatcatcttttggcagtagtgctaatgtttttatactatcctctcagtcagtagccagattatagagctgttgccttttcttctcctgaaaaatacaattattactatttttaccatatactttcctccttcaaaaagataagtaaagtgacagatctataatcaagtagacatcacaggtttgaaaaatgagccaaccaaactactgcttactttgttctttagttatcgaaactaccatatagaatatttctcaaaaaaactgtcaatgataagtgactaagtcacaacaaattaatgtgtcaggtactattctaggcactttctatggtctgaatgtgactcccaaaattcatgtgttagaagcttaatccatattacaacaatgttgggaggtggggtctaataaaggtgtttaggtcatgattgctttgctctcataaatagattaaagaaggctttcagaagtatgttcctgccgcctttccaccttctgccatgtgagggatagatttgtcttctctggaggacatagcagcatggtgccaccttagatacagaaattgaacgtgctggcaccttcatcttgtactctccaggctccagagcagtgagaaatacatttctgttttttataaattacccagtccatagtattctattatagcagcacaaaatacaccaagacaccactggaaatacaggacagaagagaacagacattacattctggtgtggggaacacagaaaaatataaataacaaataaaagtgtatatacatacacataaggtggtcaggagagctctttgtgatttagtgatatataagcaaatattaatgaaatgaagcgagatctaggtaaatataataaatatcaggtcaaatatcaatgaaagcatagaaaagacaaaaagaaaaaggaaggaaggaaggaggacaatagggaagaagatagaaaaggaagaaaagaagacaatacatcttaactgtcaatgtaaatcgccttttttttttcaaatagaaaacctatgctacaatcattaggagaaaaaatcataatctttggtgtccatgtaatttctacaaaaataagccaacaaatcaatagtagaacagtttgagaaaagacagtatttgatttatacctaagggaaaaatgtaaaaatctcataaaattaaagtaccataaaatgtcacacatcaaagagggctattcacagttaaacaatgttttattaagtaaaaatgtaattaaaatgtaatgcaggaagaaaatatgggaacttatacaaaaagaacaaacatttgtgaacacatatgtgtgtatatataaaatatatatagagagatttatagatatatcaaccaaaatattccctgttcttttaattcttttgtgagtgttgagtgttgcattatatagatcaaaacatatcttcttaaaattaaataggaatatacatagctatttaaatcaaatttatactttatagttttttaaatatttacataactttcagaggtaaatttaaagcctaccttttccccgaagttttccttattttccttagcaaaaagtagtatctgaaacttcatttggcttcatacatatttaatctatatctatgctgatgtatctgcctttgcatgttttacaatccctaaaagtgtatgtcttgaacctagtgaaagctaaaaaatgttgatgaaataaggcgttattctaagccacaggcatttttgaaagaatgctgtactgtggtaatattttatgattgtatctttgaaataagatatgcctcagtatacacagaataaaatatataaaagtagatgttgtaacatatacatactcaggaacatagtcaattagtaaaatttagttgtaaccaccctccacaaacataacatctgattttatattcatagaagcaaaatcaagttgtctgtaaacatttatagagaagaaatcagatcattgtaacataattacttaaaaggttttggcacaacgttgaaaagtcagagtgtaaaataacagaatttacttacaaccatttcatttaaagacacccagcaatctggtgggaagtcctgcagtagtggtactaagaactgaagacaaccatcccagtggcacaggagcagcatcatgccgatgagattaaaaattctcaccactgcactggcgagatcatatgtcatgtggaatatctgttgaccaaaatataaaatcaattcttataatcaattttttagaaaaatcaagcatactactgatagtaggcattgatgttgtgtagcgtaagcattgatttaataaaaatatgggaataacttgcagaaatagaaacagattacatttctttatttttacaataaggttgacactccactttatgaatattaaagccaactatgtctcatgagcaacagagatagcatgaatatataaatgtatgtattaaagaacatcgatgttgccagaagtttttatttattgttcttttgcatattttagcaaagctactttaaaacaaggtagcaaaatttacaaatgatgggtagcttctactctgcttctcatctcttgttatattaatagatttgttgaaagacaaagaaaatacccaaggactgaaaaccatatgccaaaggagttcagctgcaaaatatgaagtaatattgataataaattacagttaaatttatagctatgtgagtggagatatttaattgtggatactgaacataaatagaagcctttgagataaaggctacctggatttggtttaaaaacaattgtgcaacacttttaaaaatcataactatttccataaactttttgtatttttatggtacaggctttacttttcagttactccttattgtttgtattttgatgaaattcagtatggtaggttagattatttcagaaaacacaaacattatgacaaatcaacataatccatcaaaattttataaatggaaacaaatacccatctttacatctgtaactactcatttttctagaatttacaagaaatagattcagaatgtgagtcctttctttagcagtttattgtactctctaactggctgctaatatagtttctacttatattttacctagtctagaatagcaaaacccacttgggagcagacctacattgtagaactaagttttgttataattgttaaggaattactgcattaataaatacaattaaatttgagtaagtacttataaacacaataacttcagatatttagaatcactttttgtataattcaccaaaagaatggtgtgtttttgaagtaacaaggtaaacttgtattgaaaaattatccaaaaaatgtaaagaaaaccaaaaaaaatacatttggttttagaaatgatatctttgtaggaaaatatctataattcttaaaatacacacactgaagtactcagaggtaaaatgacagggcatctgtgattttgcttttataaaataaccaaaatctgtctttaattaaatgtttttcagtttgatatatttctatgagcattaattctttctttaaacaatctttttgacatagtaattatagtgagcaaaaagatttttttcgtgggaatatacacactgttctgaattctttttaaaagaaagttggcagttctaattttaagggcaacagaccacatattttgatattcagacagctatacacacaacttattatatagcattaagaattttacttttctgtaagctactttttattttggttttaaatttggaaaacctacagaaacatccttttgatattattccctctgatatttcttggtcactgaatacataaatagaaactctactaacaatttcatcaataatttctcattaaaagttatataatacaacataataaaaaagctttctactgataaagtcggaaaaagtcatcatgaacttagtttttttgttgttgtttagtaacagaatttacatttatatcttaatatttcctgagaaaatcatttaagatgtcttgtggataaagactgcgttttgttgggaaatagtgttaaattgcagaatataaacttctggaaaaaccaggaagcttatcacatttcagcccaattatttgaggcaactaataactatctgaaaatattacaaaatctacaaattataagtatacaggcagtggccatcattcaattatcaggctttagagtggagtatggaatggtctagagaactagcatcgattcttggtagatctgactgggtttttcttgcattttctacttccttttgggaaattagattcttttcatgggctctcaagagataaagataaaataatatgctaagttattcaattcctttaagaaaaccctattatctctaaaatgttctctagagagacaggaccactaatttcatagaggaagttaatggggatataacatcaatgataacactttagaaacactttttgttttgctactatgcattttcatgaactattataagattatgcctagattcaagcctatctgctaccaaatagtcattcccaattccataatgttaggtagtgctagtgctggcttcatacagtaactctactatctttagagtactcagtaagaactcacataattaattttataaacagtctcccttatggacattaatattatgtgttcaaaattgacatcacttttggagctatcccaaaatttaactttggagaaggtacaagcaagttgggtatttttacactggttaatagcagaggcaaatttcaactagtcaaacccatatatcttcatctttatttatctaactgataaaagagcatatgtaaagtatataatattacttgtgatgaatacgtgaatgtgtgcattatctcggcccgatctgattgtcttttgaacccttataactaagatactctggcaggcataatcattacatacgatctgaatactgagattaatagccctgttaaaactttactcaagaaagatttggaatgagaaggctacttccttacggagctcacacatctgtagatagtcaggttaaccaaagaaggaagcatctgatctaatttatgcacagccacaacttattattaataagggcagcttgtaggataaatctaagtgtgactttattcaccttactaatcaagtggctaacactattgatcaatatttttagtttttcttcatctataaggtggacattcttaagtaataaatttccatataaatcaattgtcttggtgctattgcatgaaaacttgacttcatgtaaaatggcaccatgaatgaccctcagtaaattgttactaaatgaatgaatgagagagttgaaggggtttaataataataacataaataaccttttatggtgtaccactttgcttctgtatcttaaacaagggaattaaaacaaacaaaaaaatcaaaaacttcactattattttccatcttctaagtaacctgacttgaaacctaacctcaggttagggtaacagggtaagagggctcagggttggggtaacagaaagaaaggctctcttccccgactagcaatacacttttaagttactttcaagtggtatttacaggagtcaactgaaaaaaatgtaattaaagtaagtttttcagccaggtgcgggggctcacacctgtaatcctagcactgtgggaggccgaggtgggtggatcacaaggtcaggagttcgagaccagcctggccaatgtggtgaacccttgtctctactaaaaatgcaaaaattacccgggcgtggcggtgggcacctgtagtcccagctactcaggaggctgaggcaggagaatcacttgaacctgggaggtggaggttgcagtgagtcgagatcatgccactgcacttcagcctgagtgacaaagtgagactttgatgtgaaaaaaaaaagtttttaaacaactctttaatcttattttcaccatatctagactacaaacaatgtctttaggagacacggtgctttacatttgtccagctcaggacattgtgctgttcatgtgaccttaataagaagaaagatctggtcacaaattctcattgaactttttttatattataggtttagaattttatttagttggagtccaataactccagacaggataaataattaactttctaaaactgaaaaatgctctaggatattttaagtcagaatcccaaattctaccttaatatttgcgaatcgttcatcataaatgtgattttttgtgatattttcccaggagcaatgtttatttcatcttgtttttaaaaggtctttctaaactgcactatacaacagatatccataaattggcttaattcttttaaaatgcttccatattctttcctgatgaactggattcatcggtctttcaatctaatagcttgtatataaaacgaatgaccttaatctatgcttaattatttgttctattttgtcttccttaaccaaaaaactatcaaaaataattgaagactctttatattgtgcattaaactgcttttagtcgttgactttacatactgggataatttctgagctagtttgtgtgatctcaatattgattcaagacttcttaatacaccttcgtaagtatcaaaataagattaagaaaatgggccaaaaatgcctgtcttgacagagaacattctattttaaaaggtgtaaaacaaggttagattcttctgtttctctttatatttcggcacctgcacgatttgttatattttttagatggagtgtatacataccatcctgacacaaaattaaaaaaacagctactcagattcagttgtactgttaacatatattcagggctcaatatgtaatagtcctaatcaatggtaaaataaatattttaaaagccctattatacctctgtgattcttgccctgaaagtcattcaggtcatctttccatgctttaggtacaaagtgtagaaggttttacttcatatgagagaataacactcttcatagtaatctcttttaacactgaccaatgactgcagtcattggatgaatcttatcagtcccctttttaactaggattttatttggactgagaataccttaacattcagaaggtcaaccatctgaacatttcaaaactatcatcttctgtccatagtccaaaagcaataatccactcttcagcctcctccaagtattgtcccatactcatgctcttgagtgctttttacctggattcttctttccactattccttccaaaattcctcctacataatcaattaattatcaaataccctcagccacctcacgaaatgctttctctacttctctgcttttcctgagacttaagactctccccaccaccttcccctccccaaagacgcaacttctctggtagctttctcaaagtttgttcacttctttcaaaccccaatgtcttaggttctgatgtgagtgcccttatttcctcactgccctctgacaacgtcacacgttatttgtccagctatataaaaaattattttcttaatgttcattctatttgcctacactacccataattttgctcatttctggcatcaaacaacctcccaatgtccacgtgccacacatctccatttattaagggctctgtccttttccactgcattttctctgaaaaaaaaatgtcaacttctgattaatcaaaacagccaccttgtatacctaaactttggaagattactggagagcaaactgtgtagcttgtactacttaattttttttaaaggatagcaaccttagttgaggccctcagcaatggtctatccatttccctattcctaacaacaacccattctctctttctacttccccaaagcccatgactatcttcttcagtttcagcttaaagttttatattttcaaaaggaatactcttatagttgaattccctcaactttgggggctagattaacccccaaagatttaaaaacaataaaatctctcaattcctaaaaaacattttaattgaaaaagaatcttcacttcctaggtattttcctaattctttttttccctctttttagtcttctctgtttagcttctcaaacacaactcatcggaactttgagacacagagagagctggcctgccttacagggtaaaacaaatttcttctcatggctatatgtacacatttccaggaggcacaaagcaaaatttgatttccagaaggacagatgtttcatagctactctgggcctctgattctcaaaccaacccatatatgaggaaaatgtgaagatacttcaggctgactttatttcccaaatggtgtatcaaaacttaagaagtctttcttctgagaaatctttttgaagtggcacagatatgatgatacctttgaaacattagagaaatatatgtctcattacatgactgcagtgaagaaaatagtacttttcataacaacgatatgctcatataagtagttatagaacagaatgtattctttatcaatcatgagttgtaaaataaagtataggtgtatatgttattttaatccaggtgttcctttaataaacatatacatgtttgcataaaataaaaagaaagcaattttagacatttcagttattttttagaaacctgttatgtttcttaactaccttttcaactatattttaccttggctattactcagaatttctatatatgtttcattttatttgctgctatgtgatataccatccatttctatgcatacatattttttgcatagaattttaatttcatctatctaaaacatttatgaaaagtgtgttttttatggaaacttgttatttagctttaacagtctgagaataatcagagataatgtattactaagagaaatatcaacaaatgggaaacttaagatatgaatcctttgaacatttttggtaggaaacaatgacaggaaataggtataatgtaaactgtaaaagtacaaactttgaaatctgtcaagcacaatgcctggtggcacagagctcgtgctcaacaaatgtttttcctcctatagaagttattcaactaacaaatcaatttgtataaaggggtcagtactaataaatatctaactgagctgaactgtttctattaattttattcatttttcttcaaatttcaagtcaataccagctgacaacttggaataggtcaaaaaacaaaaatgttttgataggtgacattttggtatagttatattttaatattatagagtcatatttaaaatatcacctattttaatatgataggttattttttaactgaatctacccaaatctttataattcttaagttccttaggaaaagaaatacatcttttcaactttcatgatgaccatgtgacaggtcagaacatttattaattgtaccatgcccaggaaaaacgaaagagcaagcataacctcatatgcttaatttattttaaaaagcagcttaagtgatgggaaaatctaattatgaatgaatattggaaatgaccctactaagaagaaatttcaatggattaatactctaaaaaacagactaaaattaaacaatttaagatcattgtctattcctctattaaaaatttcaaatggctgcaaatgtagacgatatttacaaattgtgcaaccactgacatatttaaatgaggcgaaaaccacatatcttatgatggatctttgaacctcattttaatgatgtttgtctgaagattatttgatgtttactatacacacttaatttccagatgtaagtcagcactaatatattgatttgattaaatatcactattattttctgaagtttttttctaaaatttatcctgagaattcaaaataaaataccaatttttaaattaaaaaggcagtgttcttttcattgtgtagttcttacacattaaaaagaataattaaaaatcctaattataaaggagtgtgtgtgtgtgtgtgtgtgtgtttgtgtgaatgtagagaaagatggtgaaaaagaaaactaatagacaaattagcaatattctattaactctgctttggtttttccactaaaagaagtgagagtgagccttacattggggcaaactgcacaatgtctttaacatcccagcctcctgtcaccattttaagtctaaaaaggcatatgccaactcgcttattgcaccatttgataggtgaactctataggggagataacagaaagaaaaacaggcttctgaaaaaactgttaagatgaaagcaaagcttattcataattttttatgcattggtcatcacagttacatcatgcattggcacagcatcttgttattctggccaggtaagccagtcaagtgcggaatattaatttatttgagtgggtttgtgtcagagatgctctggaagaaacagaggtgttggtttgctgtcttggcatataccttccaaaagaaatcactaagtacatgattttggtattaaaccaataatattgcactacaattctttgtgaacaaaccatgcattcttccatttgattgaacttattaaaatataaaaacatattagtgcaacccccctaaaaaagaacataaaccttaaaaaataaggaagcattggcaaatttgctagcaccccaagaaacaattgagtaagacttgatctactggaaaatggcatgatttcagattcactagttggacaccttccagaaggaaggcatcataatgctccaccaattcaggtaataatagtacatatagatacatgatagatcaccttaagtgccaaaaatacttaactatctgaattgtcgaaagtttattgaagtaactaatctatgtggaagcatccttaaaagtaataagccttatttgtataagtttgatttttcatatcactgaaaccacctattaagtatttgctatgtgcagaaagtaatattaggcactgggttcaccacggcttatgacaacatcttccacatcctcactaaatcacatgaacccttaacttttctagagacctctcacttgctttaatcagcactcatttttctctagacctactggagagctatcataattgttgttttctttaacattatcatgtaatttcctcactctgtctcagtttatagttttatttaagtgggagattggttagaagagtaggtacatgtttgacaatatctttctgtcttacctgtttaataacaccttgtctggatatagaattctagattgaaaataattttctcccagatacttaaagacttgactccattccttcaagcatttatcaaaactatatctttccccaaacataggtttaatttctttagtgaaaagataaagaactttacattaagataaataaaaatggcccaaaatctatgcgtgtgttcaaggggtgggaggcaagaaatggatgatgattcatggaggtataggactgactttaaattaaaattccttccaatatcctgacctattgctcaactacattctccattataacttctgactccaactccaaatgtctcaaagattccactgtacagattggcccccatttcttttgcagactcagttgtagcatatctccgaatgtgattttatctccttgtgtcagtctgtattcttcctccccttgtctttcaactcttaaaaagtttagtgtctgttctgtcttaacgagttccttgcatttgtttccttttgttttatagatgtattcctttactcactttgattctttaattgttttggactcaggagcaacagaaagcccacatgtgttatcttatccctcctgctgaaccatgaacgtttatcttacaatgtgtattttcttcaatcatttgaattggacttatataacattgaaagtatttatataactcaaatccattaactgcatgtttgagcttcatacacttgtattccaagataaatttgaaatcactttgacagtccctctccaattcataaaattatgttggactgctgttactgagttaattaataaattgatttgtgtctatcattattttttcaaaaacttaatttacctcacattcaatctttccttccttgaaaatatggtccacttggcatccagaattatcattttacaattcaaacctgatcatgtgatttcctgcttgaactttcactagacattcaagaaatctttacgaagcccatattcttggcctggcattaaaggtcctttgtgatgtggtctctgtactaccattttattctcatctctcacccttgttctgtaggtattccaagcttaaggcaaacaaaacttgtcatagtaccctttaacatgattgatcagagtctgcatttgtttacatgctattctctcctggtatactaccttccatcctatccattttctgactgatgaccttattcatactcaaatgttgcttcctcaggaaagacttttttggcctctccaaggagaaaattaagcgcttactccaataggggcttgcccttaactctgtaaaagtgtttaatgcattgctataattacaggtttatgtgtctgtgttcttactagatagtgagccctagaggtcaagaattgtattcacaaaacatgcacttaacacgtttacaaattagaagaaagtaaaagaacggaggaaaaggggaaagacaagatggagggaggaagggaaggaggaagggagggagggagggatggagggagggaggaaaggaaagaaggaaggaaggaaggaaggaaggaggaaagaaagaaaagaaggaaagaaggaaaggggggagggagggagggagaaaggagaggggggagatcccagttcagaaacatttggtatgactatatattgtttccaaatactctttgtgactatagaatagggcctctaatctgaaaagaatacttatcacatgtctgtaataaagtaaatttatatacacatttcatttgtaatttgaatacccattcattccagaatacctgtcatcttttgttacatccttcatcacatcacaatatccatgtagtctttgtcatcattgtggtctgtcctcatttgagctcttaattacaaaaatttcattctctggtcacatcttttttgtgtgtctagcttttagttgtcattgtcttactctctctgaactgttttttaattgttgaaaatgcctaacctttacagagttctactttctcctgctctcttttccttgctcatcatcacttttttccatatccagtcagacacaaagatccattatttcaaccagtatcttatcaaaattttcaatactcttctcctctgttgtattcttatggtaatattttgttccaatattaactgactgtccattttctaagttctatacataagcttctatatatctcgagagaaccttacaactgcacaactacttcatggttttaacatcaactatgtttcctatactgtctagtgatattggcgtatttctagatagcatgcatatattctccagtgcagctagttaaaaaacttacccagattttccaaaatctatcatactaagcctgcttacctcaatcatgagaatacacttaactttcaattttattgagaaaacattgtcatttacaaatatctacacttaccctttcttcttacactggtgcatgatgtgtctctttttctctctgatgcctcacctatgtctctttttctctgtgatgcctcacctattttttttctttttttttcttcctatataatcagtgacattgcttcattaattacctcctgtcttcttcctaggactctatgtctgtttttcctcaccatcatttaagcatgcttaaatctttcctatattagaaaattatgttgacctggtattcctctcaatcctctttactaatgtctaattttcttctcaaacactgaaaagttacctacatcttcttcactttttatcatgcattcaacttttaaacatcttgtaacctggcgtttcctatctgtcatctgaaaacatccacgataaaattttcatatactgctgttgctaaatccaattaaaaatttgtaagccacatttggttgacctctaggcacattaatttataatatactctttgatactgctttcttggtttctgaaatgcaagtttctttcttgcttctgatttaattccattttgtttgtcattcatattgagtatcctcaaaatgttcactctcagatctctctagttccaccctacacattttagttgagggaaatcttccacatccatagctttccatttttacttataatcaaggcactccataaccttgacctttaatgaagcaaaatttcttaattctaaaacccacaatcaagtcaatctgaagatgtccaaaattatattaatctctctcacactctacttccctatttcatcctctacatagtataatacacattgatcctgcaagtagcttatcatgaggataatgctagacttactcagttcccttgacatccacatttaattggtgactaagttctataaatctctctctgtaaaaatttttaaactgtaaattccctactttggacaattatcatctctcacttgagttttttcaaaacctcctaaattattttcatctatctagattttccctcacttatcctgcaattggagatttctttctaaaacataagtatgatgatgccaccatcctggttaaaaatcaacaatatttcattaaatttaagacaaagggcaagctcttcagtttaacatataagactcttcatgatgtagtcactgctttcttgccaagcttcatctacttctcagttttttagcctacatatttattttcttttggtaattttacttgaaaaaggtataattcactcctccaactatgggttatacaatcattatcatcagtaaaatataaacttgtggatgggaaggatcataccttaatgtcttggtatctcaaggacttttagcacatgttatttagaacgagaataaaagggacacattttgaatgcggaaagaaagggaaaatgaatgaataaaatctataacctgttaacattaattcatttttatttaaaataaacagcacaaaaagattgaattcaaagtgtcacctagtttaaaataacctgtatatcttttgaaaacctgaatgattttggtgagatatttatttttgctgtcaattctcatagaaactaattgaaatctgtttcttcattgtttatcaataatgtaatagtgaactgaattatgagtatataaaataaactagtgattaagtaaattttgattatacataatgagtatatgaaagcagtgttaatttatggttattgtcacatgttctacaatcataaaattgttgttactggaggaacttggtttctgtgctctaaatgcatgctatgctagcagaatttttaaaatattgatggattggaggtattgtttttattatgacacagactattttgagcttttgagactattttgaattattcaaaaatattagtctccattgatattggatctgacaacataaaaccctctgtattttaaggagttccagatccattatcaatttgagctaatgggctaactctgtaatggaaaactttgactgtgccaaaattgactctaaaaaatgagatctgaatgtattcctattgaattgccatgatttaacttaatagaattcagtatttctgacaagttctaaatggaggcgtccaaaaggttactatcattattatctgggctttcacccagcatttaaactcacaaatcactgtcatgttttctgctaaattcagcattgattctggcctccacattattatttttttcttttggtatgtttatgtagcatgagagttaagagaagatagtattttatattatgtttagcatttatttagagagaaaaaatgcacttttagtttgagtctaacaacagaaaaacgttttaatacgtctacatctatatttacatttctgtcaacctctttttctaagtctcttcaaaaagaatcagcatttcctaaaagacacagatatatccaagaggccaatttctgagttgcatatacagaataacatagacgatagaacttttagcattacattttaaatgaaaatattttacaaagcatattttaaaatcataggtgagagtagctataggacaatatttttacaattagagagaggtaaaagcattctcaaggtttccatagatgtggtcaatgccacaaagctcttctgaggattttagaatcctaaaaccctctctctttcactctctctctctgtcgtgtgaggatgcagcaagaaggcaggcaagcctctgcaaactggtaagagagccctcaccagatacttcatctgctggcatctcatatcttggactttccagcctccagaactgtaagaaatcactatgcattgtttaagccaccccagtctatgatatggtgttaagccacccagtccatgatacagcctccagaactgtaagaaatcactatctgttgtttaagccacccagtctatgatattgtttaagtagcccaagaaaactaagacaagggaggcatcaatttactgttggatttcttgacctttttttcaccttactataattttatccagcttctttaaaaacttaggtctcagcatggcctttaattcctcctgaaaaccttccctgcatgctttgggattgtattggaaatcccttccttatatgttcccaaagcttcctttgttttattttagcatttatcatgctggggcataattgcctgtttatttgtctgccctcttcattagactatatgccctttatatacaggctgaggatctctaatatgaaaatctgaaatgctccaaaatccaaaacattttgagcactgccatgatgccacaagtgaaaaattctgcacgagtacttaatgcaaactttgtttcatgcacaaaattaattaatatattgcataaagttaccttcaggctatgtggataaggctaagtaaaggattaataaataattgtggaattaaaaataataatttaaataaatctgcaataaaataaatctagcaaattgtgctccatattattcccaagatacatttatatcaccccaaggcatacgtagatgagttgttacaattacatcaggacataatttcaaaatcctaacacctagtataaatcagcactgtgtcactgacaacactttgtattataccatgatttctcaaactaactaaagtatttgttccagaaacagaaaacttccatgtttcatcactttatcaagaaggtctgggattcaaccaaaaaaaaaatagaggtgaagggtagactatgattatcttaacaacattgctcaagtttaagagactaacacattgttcagtaagtaaatattgaggaagacaatataatcattcagaatggtgatctaaagtttttctacagaagaaatatcacaaactaaagtacctaaaaatgtgcgttgagaaataatagataaaagccagtatgagcacttttaaagtcaaaggcaggttttcttcaaaataggagagaataaaggtcagggaaaaaaatagctcatagttttattggtgagcaggtccggaaacctggtaatatgtgtttgtaaagataacatagacaataaataaatgagggaagaagataaattattcaaagaagaatttagaaaaggaagcataagataaattctttgaaaaacaacaataacattttagtcaaacatattttaagttaaataacataagtaatgtgcaaaaatgtattgcaaatatataaggaaaacactaacacccaaatagaaaataatgtaaagggcataacatgtctcactaaagaaaaaataagccaataaaagtataaatggtattcaacctctgcataaaacaaaattttaaaacaagctttaaaatgaatggtttttaatgagataccatttttctacaagcatagtggttaacttggaatatattattctgttgagaacgcagaaaaaaagacactcattcactattggttaaaacataaattatataaaatgacaataatacatcagtatttccaaaataatccatatactttgaggcacctataatcccagctactcaggaagctgaggcagaagaattgcttgaacttgggaggtggaggttgcagtgagcagagattgtgccactgcactccagcctgggtgacaatgagacactctgtcaaaaaaaaaattcatatactttgaaatagcaaattaaaaagtaaaagccagctttgtgaaaatactcagaactgtggccaaataatgtacatagggtgctcagggtaaatcagtgaaaaaaacagagatttctactattgtaaaaatgaagaagtttacattctattgggaaaaggggcatagacaatagacagtaaacaaaataaatatattaattatgtagaatgttagcagatgctaaactttatgaccacaacaatgtcaaagctgagcaatgtcagatcagttaacacagatggcttgtccgaagaggaacaagggtttgagcacctgcaatacaaaatgggattatcagtacatcagcacaggtaggcctcatttttaaaaaggttggataaggtgatagttatccgtactaattctgaaagaaaagaatcacagtgagagagatcaaccaatgaatgtaagggtcctaaagtgatgcatgtctggcatattcaaaaatgctaggcaaccagtgtggccagaacagagtagaagaagcttccttaaaactgaagccagagaaatataatgtgtgtggtgtgtctgtgtagattttgtgcagcaatacgaaaaccttactagtgagtaaaagttagctaagaacaatgaggaataagtaaaagtaataaagaataagctgaagaaggcagggcgtggtggctcaagcctgtaatcccaacactttgggaggccgaggcgggcagatcatgaggtcagaagttcaagaccagcctggccaacatggttaaacccgtgtctcctaaaaatacaaaaattagctgggcaaggtggcacgttcctataatcccagctacacaggaggctgagactggagaatctcttgaacctggacccaggaggcagaggttgcagtgaacagagatcatgccactgcactccagcctgggctacagagcgagactgttttaaaaaaaaaaaaaaaagaatgagttgaagaagagaaatgagctcgtgaagagtctggcagtgagatgtcctggtgtgtgagtgactcctaaagaaattcagtatagcatctgaaaacgagtgtggaaaggaaggggaatcagggtaaagagaatgggctgcaattaaagattatattggaagcttgaactatgaatgactttagaagccttatttaggaaagtaacaatattatctcatgggttttgaatagggaatgaaatggctaagttttaattttaggaataccatccctttaactacattgaataattaattgtaaaggagaaaacatagctaagatggaactgactccaaattgttgttggaatagttcaagcttcagataatgataagctgatgctgtggcagaagaaataaaaggcaattgaagaaacagaactgacaatacttgatgatgaactggatgcagaagacaaagagaaggaaagaggcacagtggctcctaggtttctaattgtggtatttaggtaggtggaagcattcaacactcaatataggaaatacaaagccattttaagaggaagaagaacaggatttcagttttggacactctaagtgggtcacagcttaacccattggaaatatcctgtaggcagttacatacacgtatatcatgtccaaaattatagaataaaaagcaaaagttctcctctttatagttgtcttatatttttaactaatcatttcacataccatttcttctcctaatatattctggaaatcaatgacagaatcaaaaacagattaagctttccataaaaatctctgatcaaataatctcttacacaaaaacttctaatgacttaccattttctctggaattaagtaaatcattctagcctatgaggggctcatactgccatgctcgatgtgctgaaataagctcttcaacgtactccttgcttatgacagagttatttgcatatactcaaatatacctacccatggtttatacatttccacattttttttagtgaaagtccacatcaccaaattgcatttattataaacctgctcattcttctacatctagcaaccttttccatgaagctaattctaatacaaaagttatcagtggtttctctcctgacaccccatgcttccattctgtagttttcataagctggtttgtgttattgttttaattaagtattttatatgtttctctaagttttaataacttgacataactctagcttttaatacatattttttaaataacaattgcaataagtagatagagcaacatatccactgaaaactcattaagtttgagcatttgaatgtcagctggaagagatggcatttatataaaaggctgtcagccttcaaaaaagaaagggtgggcatatcagagctaatggcttgttctgagattgagacactcaaatgagaagggaggacagagatcatatcttaactcatgaacaatgactgaaatggaaattaaaataactaggaaggtcaagaataaatgtcccgggacaataaatatgtttttaaacttgagtctgattctattcaatgttattaacaacatgttttctactttagtccctgatcatttttccagagtcagtagactgtaagaaacctacaaaggaaaacaattaagagagatcatcaatattataaatactggattaaatacctcatttggtaggatcctaatacaattagaaagtgtgtaaatagttcttgtaatataactagcatctttcaaacactatgtcatatgaattttgaaaattataattctacacattcagaaagccctaacctagtagttccattattcgaatgctagaatgtaaggcttagagtttaaataatgtttgtttcatggcagagaatagaacagaatcaccattgctatactgccttactagggactaacagttcagtaaaagctacatgaagcctacattttaaaaaggtgaagagagattctgtaaataggaaagcaaaacacattctggcattgacttattaagagacctacagaagaataattaaagccatgcactggcagaagagaatttggcatcaatggctgctgatatctctcatgaacaccaacaaggatgtatataccacgttttcttcctgtcaggaaacagagatttaaagaacctggatctcactgattcttctaatcttggtttcaaactagatatgaatctcattatatatggctcctttgcattttttcatgatttgggcgatggaaactaagaaggcaatggatgcagaatgaattaagaagataggatcaaacctaaaaaggactggtgagaagctgacatagtttggaaagaaatgagaactgatttcagttgtgactgaaagttgtggttagactagtgactggaggactgatgaatggaaaggaacgtgtactctgacatagcagctgaagctacaatgaaaggaaataatctggtatgttgacagatgatctagagtgaatagtgagatgaagacttttttggtggtatgtgtctgggacagactggctttcctctctcgctccataccacatgcacctattccctttcccttttgtaatctttttcttttccatgatgccacttatggcagagtcaaaggaacatagctttgaagtcagatccaggtatgaatttacctttgtctactaccaactgtaattttgagaggtttactctcagtctctgttttcctcatttataaaatggggatgacaaaatatctatttcagagggttgtattgaggataaactgaaatcctaaaagaaaaacaaacaaaaaaaacaaacaaaaacaaatgtagttgggtatgtgataggtgttcagtaaatgatcttggtgaggcttgttttcattttcctttcaattgccaatctgtttccttttggtcttgttaccagttatctgataaattaaactctgactccactattataaaaaacctggaaacgattaaaccagaaagaagacaaaggctgggtgtgagtttaaaggatttcagaaatttgctgatcttctgtgtgcttcaatgtcaggaattagaaggtaggcaggttcacaaacagtggcagcaccaacagtggcagggaaaggggcttcatgccctcaactcacaatatccacctgtccaattctttcatgtggactagaggtatattctcaacctcacgtaaagtgtagcttccaacactatgtatgcttccctcccctttcaagagattgatccccttaacatcctggagttgtcacagtttagaacaaaaaatgaaagaaagaaaaatagcaaaaagactttccacagcaagacatctgggggactatcaataaatgtaatatagttgagacacctccaaaacgatttctgagcctctcccagccccgtggaaccagaatttctgaaagctgtattgtttttttaaatttcaacttttgttttagatacagggggtacatgtgcaggtttgttacattggaatatttcatggtgctaaggcttggaatatgaatcccgtcacccaggtagtgagcacaatacctataggtagttttcaacccgcccctcttcctccctctaccctctagtccacagggcctattgtttgcacatttatgttcatgtgtgctcaatatttagctcccacttgtaagtgagaacatgtagtatttgtttttccattcctgtgttaatttgcttagaattatagcctccagccccaactatgttgctgcaaaacatatgatttcatttcttttaaatggcaatatagtattctatggtgtatatgtaccacattttccttattcagtctaacattgatgtgcataagggttgattccatgtctttgctattgtaaatagcacagcaatgaacatacgagtgcatctgtctttttggtacaataatttattttctttggggtatatacccagcggtgggatagctgagttgaatggtagctctgttttaaggtctttgaggaatctgcagattgctttccacagtggctggactaatttacattcccaccaataatgtataagcgctaccctttttccatagctttgccagcatcttttgttttctgactttctaataatagccattctgactggtgtgatatctcacacagtattctgagtggtattcattgtggtcttgacttgcatttctctcatgattagtgatgttgaattttttttcatgtgtgttggcgacttgtacatcttcttttgagaagttcatgtagtttgcccatttttaaaatggggttatttgatttttgcttgttgatttgtttaagttccctgtagattctggatattaaggctttgtcggatgcatagtttcgaatatgttctcccattctgaaggttgtctgtttactttgttgacggcttcttttgttgttcagaagctctttagtttaattaggtcccacttgtttatttttgcttttgctgcagttgttttgggggcttagccaaagattatttgccaagctgatgttgagaagagtacttcctaggttttctgccatgatttttgtagtgtgaagtcttatatttaaatctttaatccattttgagttaatttctgtatatgatgaaaggtaggagtccagcttcaattttctgcatatggctagccagttatcctagcactatatactgaatggggagtcttttctcattgcttatttttgttggccttgttgaaaatcagacgtttgtaggtgtgcaactttatttccaagttttcgattctgttctgttggtctatgtgcctgtttttgtaccaatatcaaactcatttggttattgtggctttaaaatatagtttgaaattgggtagtgtgatgcctctggctttgttctttctgcttagggtagtgaaagctgtattttaaacaaatccccattacatttttctgcaaaataaagactctaaaaacttggccaggctcagtggctcatgcctgtaatcccatcactttgggaggctgaggcgggcagatcacaaggtcaggagattgagaccatcctggctaacacggtgaaacctgcttctactaaaaaaaatacaaaaaaattagccaggcgtggtgataggtgcctgtagtcccagctacttggaggctggggcagcagaatggtgtgaacccgggaggtggagcttgcagtaagccaagattgtgccactgcactccagcctgggcaacagagcaagacgccatcttaaaaaaaaaaatccgtctaaatataaacagaattacttcattggacttccagggaagccctttggtgcagacatgactcaaagagggggtccccttgccctccccctctcttccttttaaaatgagaatgtgacagtgaggtcatcggcagttatcttgtgagtataataaacttgatgcctccacagtctaagactagtggagctgagaataagtaagtttattctgctcctgatgacctcggacattccacataacccctggactctagatgttatcttaggtctctaacaacagtagctaaacctaatcctaattgacacagtgcttatacttttattaagttattaattttaaaaaagacatcagaaagtgttcaaagtcaatgtgaatgtcagtgtttggtccagaactgagtactgattttgtgcatgagctcacattcatggggtgggtggaagcatgcttggcacagaaatctttagaaagaaaagcagctctgaaggccggaacacctgtgatatatagggcacaggtggtaatttggcaactgtaagcctggccttttgagctgtggccaaaactaaatttggataaactcattatccatacatatgccctaatttcctgatagatttcagtcagatgtggtaattttctgctcagcttccttatgttatcacttattacatttgctaatgggggcggaaaaactgttctaggagaatatccaaaagcaattgattggtttgtattataatgtaggcgctaaaagaattagtttatttcaaataagtgacgacttgatgccttgtaaatatcttccacacatgcctcattttagttcttcctactaaggcatatgactatcaacactgttaaactttgcatgtaaaccatgttcctttcctctccatctcctcattcttctgaatgtctccactctttcaggtacataaaaattttttagaaattacccccaaaatgtgaaagtacaaaaaatggaagcaaacttaaattttcctcttattaaaaattatgactaaacaataaaacaaaacagttttttcatctcatctgcataattacacataatttctattttatgaattcccaacacttacgcagaagggaaatactcatggcttataatttatactttcataaaagtgatatgtttctttttttccaaagaatcaaagagttaatatattcactacttgtaaaaaaaatacaactcaggattagaaaagaggaaagttgtcaaaagatagtacgatcgttcttagccttgcatagtagaaaagatccaagggttcaaaaccaagtattgttaaggcatgatgttatattctcatgtggtgtgcagggggtgaaggtcactaaagaagcatcaacagatggtatcagcaatgataactacatgttttcagaagtaggttcaggaaattatcctcctacatggagattagttaggccccatagttaggccaagctaagtgacaataatacaagtagctaccatatgagtgtttaccattgtatttgagttatgcactatcagtatattaattcacaagttagaaaatgaggcttacagaatttgagtaaattgctcaggacctcacatactaagtgatgcatgtaaggttcacatccatgcagtctgactttggagatcatgttctaggcttcacaaaatattttctctatttggcatgtaagacattcttcttgttgaaagccatatcaagactgggagaaaggtgtttatgtcatccagaatgtctgactagtctcccatacaagattttgcgataggaggaatcatagctattgattaattggtaagtgcttatatttatatccactgtcaaagcctcaaaggttgtggaaattaggtaacttgtcaaattgtaccatactggaagaaatagagctagattttaaattcattctattacaaaaaccttgttttttacccaacatgacatggataaagaactactattctcctactaaacatataaagagtaactattgcacatgatattaaatatactctcatggggtgtattcagaaacatacatcatcaatttttgttgcactggctacatcttcatccttcatgtggccatcacgttctattaatgatgatttttaaagaagtttcaaaataaattttaaagtcatgcaatagaattaatagcaaagctactttaaaatataacaatgtactaacaaacaaatgatgaaaaactatcttcatagctcatcaaaatctttaaagtataatttgttaaatattttaggaatattgtacaagtataatatcacaagaaaagatattgtaagggaatacacctaagtctatgtatgcaattaaatattcatgaacttttataatcagaagataattcatataaatcttcaaatatgaagtcaataatagtaactgaccaaaccaaaccatctatgttaggtggtaaattagatgttcacaattatcacagttgtcctaaatacagtctctactgcctaattttcacaagtgtctcttctatgtttccattggtgtttcctgtaagtcgtcagatgttttacatcctctttagcagtaattgtttcttacttccttaagcagtataattgtaaaggatacagcaaaactttgaacagtcctctgtacctaatgccaaaacaatctgaaacagaaatgtcagtattttaacaactttaggtcattaatcacagtctattcaatagtaattttcattgctgaaaaatgtttttgattaatatacttaaactgaaaatcttgttcataatatcagacagatatttaagaatttgaaaatgatgagcacataaattttgctgtactcttcatttggtaactatataggaagaataaaagttttcctaaaaatatttcttgttcaatataaagtatatttttgagagcggcattgtacatttaaaaggttagtaggatgatggaaattgtgcagtcagctctatgtattctgttggttagagcaatgcatggtggcccaatcactatttttaatatatctaggccatttcaaaattaaaaggcatatactgtcagagttttgcccctgtgtgcacttcacaaacatgaaaatccactgtcatagggtgacttttcaaagacatatgtgcacatatgagggcattttctgatttttttccaattgagaaattatacaaaataatgtaagttcatgttccaatgtctatggctttaatattttgcattttcaaaataatgcaagaacagtattatgaagtagtatgttacacacaacaaggtttgaagaaaatttagtaaaacttagtcaagttacttctttcaaaaatcttgaaagtctgaattaagtaaatgtgtagccagatctcatttgctgagcgacagagaagaaacagaagggtttcgatctaaaaatattgatttgatatctcctctttttaaatgataaaacacaatggattttcatacttatgagaagttgaactacactgtgaatatagtaatcttgactagagagtatacaacgtgtattaaatgtgaatcatttaaatttggatgaatacatatgcaacctaatactaacatctgcccttattccttgttcaagtcttggctcaaattttacattctcattgaggtcttccttgaccacctggtttattattgcaaactaccttctcccaacactaccccaacgacctgtccctacacttataattctcttatgcttcttttaattttttacataaaattaaaaattgatttcatgaaattatgtaatttacttttgattatgcttatttctgtgtgcctctgctaaaatataaacttcagaagaatggggaacttagacactgaaaggcatttagtagctcaataagtacttgttaaaagactaataatattggcattgaggaaaaactgatgaaaatacttaatttctccatatctcaataatttatatcaaacagcagggactgtttatattctgttgttatataaaaataacaccagtcagttgtgctttcattgaattccatataatattgctttaaaagatatacggcattttcgtattttcataaaatatattgaaatgctctaaagagctgccagagttcataaaaaacaatcttgcaaactggctatagtacttggaaaagtggaagcaattcagaaacttcaaaggttgcagtcctactgagaaagatgtagtaagttagagaatattggagaaagcatagataactatttaactatatgataaataatttcacagccactgctgttcctccagccattcctattcttcatgttttggtatttatatttagtttatattttatactaggtgttttgaccacaattgtgtcaagaaactgaggaaacacacatcttcaaagctcacctgaagggcactgcagtttgtgttatgaaaggcttttgccttaaagccttgattttacaattcactgaataaaacagttgctgaatgcctgccacaaatcttgtcccgaaatatgaaagtctggcatgtactcaatgtacctgactctcagacaggtaaggcctcaagaaattcctgagcagggaatcgttaacttggagttcagaagagttgggtgttggacacaggcttcagagaaggcaaaatatttaatctgagttacatttggagtaggatttctaagcgaagatgccagaggtatagcaagaaattgcagaaatgcaaagttttgttgcattttggggagaattaatagttttctgtgttgggaagctagggcatgtaggacaactataaacattgtgcctgaaaagataacttggggttaagagccttgaaactcatggctagcatttaacttttattctgggaccaatagtggggaatccctgaagcaatttaacaataaaataaaaatgtatttaaatcaattccagaataaaagtgtttttctgttaataagaagcttgaaaagtacacaagaaccatggctggagtggattggtgattcttcagaaattccatgcatctcccacactctaattcatgacaataaagtgctctctgtttccaccatgattaaagctgtggtcaaactgaaccttagcttctcgttagccagatccttaggcaaccagcttcagtttctccagtaaaggcaccaaagtatttagcatggtcagcttataacgagtcaatctatgatgagccaggcattgtctaggtgaagtgttctccaagatgtggttcctggtctatagaagcttcacattctaactttagagacagccagtgaaggtacgaagtagtaggcaatgtgatataggctaccatagtgggtgctatgacaaaacatgacaaacaactaacctagtccatctggggctgacaattagggatgtcaggtttagcaaatacaaatatagttcattcaattagcgtttcagataaacagtgaataattttttagtatgagtatgccccaaatactcaaattttactgggcattctgtattttacttggcaaacctactgacaatactttttggataagacattgctggagcagcatctttacgtatagaaattaaccaggtgaaacatgttaaaaagaaaatttcaaacacagggaacaacatgtgcaaaatatgaagcaggggagaaaatagctcatttggaaaactgcaaggaaattcactataactaggtcatagaatgccaacagtgcaatacagatacatttgcaggttagtcaggagtcagatcatgatgagattggattgttttcctgaaagaaacagataccaaaggtcttgctgatagattcgctataaatttgtgtttttccaaaactgttggtccttcattgatgcctgacaaatttatgggttttgctttctttacataaatgtaatggtattatttattttctccagttatttcaaacatttgtgttatcttccagcctccttgtcccttcctctttctgagcattcttaccaaactgcttctttcttcccagaaatagataaaatgtgatgccacaattcccagtcaacccttacccattaactctcctccagttcacacctaccacttctgctgctgacgtaatcataaatattaaagtgtttgaccaacttttcttatgattcttactcttttcttggtcttatttcacattgcatgcctgtatcaaaacatctcatgtgccacataaatatacatacctaccatgtactcacaatttttttaaataaaaaacttaaataaagatgagtctcccctttcttccaactttcatacatgtataattcctcaatttttgctccagaatagaaaccatcctttcctaagtacccttgacctttctataccaatcatcctttgcctagctcattttatccacttcttcctctcaactggccctatattccaggcaggagcatgttcaaggctcttccatcttaaaccaaaaactttccctcaaattgcccaccttaaccatacatcagttttcctatctttatgaatctacccttgctatataaacactttctctccttaagtcactaaggcttggcttctgcctcctccatttatctaaaccatcttgcagcaaagtaataagcgaatcacactcggaatctgtatatgaaaattaaatattaacatgtattgccctagaactctacaatattaggatatacatattttggaaataaattttatattctgttattcccagcaacatatacaagctaactcatacttggtaagtcttacgtcaagctttatccaaaatcagcatcaaattttccctttaaagtctcacaatgtttctacaattggtgtccatactccaacaaacacataacactctgtgagtatatcataattatgatatcagttgaaacattaaaaaaaacaaatttgaaatttgagcaggtaggggcctttaacttaccttgtgcgctcaagtattcacactgtccaaacctttgccactttttcatagacttgctagttacttattaagagacttcataaattgctcaacctctttgaacttttttgatttcctgtatgcctcattcatttgtttacttacttattctgccagtagtttatgggtgtgctttgtatttagacatgtgctatgctataggacattttcagttgaataacgtaattccaacacttcgtgtcctttattttagctggaaaaattaatggattattgtgaagagtgaatgagaaaaataatatgtgcaagcaagttacagaataaaattccaggtcttgaggaaattatgcagggcctctataagaaggtaaggaagtggtgaaagctaggctggggttctctatttttcatgaattcaagatctgacatggtgtattcctaaatgattaataagtactacctatatataaatgtcatgttaacacttatgaaattttatcagaacatggaaatacataaccaagtataacaaaccaagacaaacacttcatttgtccaacctcatctaaaaattttagataatcactgaatttctaggcacctttatcatgcttcacaagcagcagattaagctaacacacatcatatgtcatgagtgttacaccagctactcctacatcatgtctagctatcatatccagcattttactacaaatcatttcttagaagaaacccttcagtacaggcagaataagcactagagatgcactagaggcagggagccatttttaccctcccaaaacccactctctctctcaccaaaactctgtgtatgtgtgtgtgtgtgtgtgtgtgtgtgagagagagaggataggtgtgacaaataagctaaatcaagctttgagaggatcttagacttctttaaatgaatatatatatatatatatatatatatatataaaatttgaagtaaaatcttcttttcttatccatgctcgtcaaagttctttgctaaaactgtgtgagacagtggcgttaccagcaacagtttttttgttttttttttttttttttgagacaagagccttgctctgtcgcccaggctggcactcactgcaacctccacctccccggttcaagtgattctcctgtctcagcctccaagtaactggggctacaggctcgccccatcaagcctggctaatattttgtatttttagtacagacaaggtttcaccatgttgcccaggctggtcttgaactcccggcctcaggtgatccaccagcctcagcctcccaaagtgctgggatcacaggtgtgagtgttacattacattttaacacatttctttttaagatgtaagtacttgttatcatacctttattttgttttttgttcttagaaaaactctttgaggcatgagaagaaactagagtatggaaagcttagaaaagtctgtggattggtcaagctgggaccttcatacaatttaatataacttttagtccaggataactcataaaatgtcctggaagtgaactgtaaaatatagagagaatcattctttcttataatgcagtatatattaattgtagactatttctcatacaaattcttgtaaaatattttactaggcacaccttataaatatactgagactaaatatgagtttagtctcaaaaactactgagtttttgcagctcaactgattctggatttttaactatttatttattttgcataattgaatgacaaatctgcaatgacatatgtatatatagatatatatattcacaaaacacaaacatatatataaatttcagtcaccaagaataaagaaataatgaggcgtcacgatcatctgaaaacttatcttatactctaacaaaaaataaatcgagttaaatataattttctaatgtctccaagtccatgatttttcctcattaatgtaatagttttatatattccttttacataaatgaatgtttttacactaaaatatctatgttttgtgaaaatttataaggaattgcaattttaagttcctttttgtgtctatgtttctacttttattagaatatatttaccaatgtatttcaattgtgtttctttttttttagcttttatttttttttatttattattattatactttaagttttagggtacatgtgcacaatgtgcaggttagttacatatgtatacatgtgccatgctggtgcgctgcacccactaactcgtcatctagcattaggtatatcccccaatgctatccctcccacctccccccaccccacaacagtccccagagtgtgatgttccccttcctgtgtccatgagttctcattgttcaattcccacctatgagtgagaatatgcggtgtttggttttttgttcttgcgatagtttactgagaatgatgatttccaatttcatccatgtccctacaaaggacatgaactcatcattttttatggctgcgtagtattccatggtgtatatgtttcacattttcttaatccagtctatcattgttggacatttggcttggttccaagtctttgctattgtgaataatgccgcaataaacatacgtgtgcatgtgtctttatagcagcatgatttatagtcctttgggtatatacccagtaatgggatggctgggttaaatggtatttccagttctagatccctgaggaatcgccacactgacttccacaatggttgaactagtttacagtcccaccaacaatgtaaaagtgttcctatttctccacatcctctccagcacctgttgtttcctgacttttgaatgattgccattctaactggtatgagatggtatctcactgtggttttgatttgcatttctctgatggccagtgatggtgagcatttttcatgtgttttttggctgcataaatgtcttcttttgagaagtgtctgttcatgtccttcgcccactttttgatggggttgtttgtttttttcttgtaaatttgtttgagttcattgtagattctggatattagccctttgacagatgagtaggttgcgaaaattttctcccattttgtgggttgcctgttcactctgatggtagtttcttttgctgtgcagaagctcttgagtttaattagatcccatttgtcaattttggttttgttgccattgcttttggtgttttagacatgaagtccttgcccatgcctatgtcctgaatggtaatgcctaggttttcttctagggtttttatggttttaggtctaacgtttaagtctttactccatcttgaattaatttttgtctaaggtgtaaggaagggatccagtttcagctttctacatatggctagccagttttctcagcaccatttattaaatagggaattctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgagggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcacgtcgtctgcaaagagggacaatttgacttcctcttttcctaattgaatacactttatttccttctcctaactgattgccctggccagaacttccaacactatgttgaataggagtggtgagagaggtcatccctgtcttgtgccagttttcaaagggaatgcttccagtttttgcccattcactatgatattggctgtgggtttgtcatagatagctcttattattttgaaatacgtcccatgaatacctaatttattgagagtttttagcatgaagggttgttgaattttgtcaaaggcattttctgcatctattgagataatcatgtggttttggtctttggttctgtttatatgctggattacatttattgatttgcgtatattgaaccagccttgcatcccagggatgaagcccacttgatcatggtggataagctttttgatgtgctgctggattcggtttgctagtattttactgaggatttttgcatcaatgttcatcaaggatattggtctaaaattctcttttttggttgtgtctctgcacggctttggtatcagaatgatgctggcctcataaaatgagttagggaggattccctctttttctattgattggaatagtttcagaaggaatggtaccagttcctccttgtacctgtggtagaatttggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgaaatagtttcagaaggaatggtagcagttcctccttgtaccactggtagaagttggctgtgaatccatctggtcctggactctttttggttggtaagctattgtatttctgtgggatcggtggtgatatcccctttaccattttttattgcgtctatttgatacttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgttgctcttgcttttctagttcttctaatcgtgatgttagggtgtaaattttggatctttcctgctttctcttgtgggcatttagtgcataaatttccctctacacactgctttgaatgtgtcccagagattctggtatactctgtctttgttctcattggtttcaaagaacatctttatttctgccttcatttctttatgtacccagtagtcattcaggagcaggttgttcagtttccatgtagttgagcggctttgagtgagattcttaatcctgagttctagtttgattgcactgtggtctgagagatagtttgttataatttctgttctttaaatttgctgaggagatctttacttccaagtatgtggtcaattttggaataagtgtggtgtggtgctgaaaaaaatgtatattctgttgatttgggatggagaattctgtagatgtctattaggtccacttggtgcagagctgagttcaattcctgggtatccttgttgactttctgtctcgttgatctgtctaatgttgacagtggggtgttaaagtctcccattattaatgtgtgggagtctaagattctttgcaggtcactcaggacttgctttatgaatctgggtgctcctgtattgggcgcatatatatttagcatagttagctcttcttgttgaattgatccctttaccattatgtaatggccttctttgtctcttttgatctttgttggtttaaagtctgttttatcacagactaggattgcaacccctgcctttttttgttttccattggcttggtagaccttcctccatccttttattttgagcctatgtgtgtctctgcacgtgagatgggtttcctgaatacagcacactgatgggtcttgactctttatccaattcgccagtctgtgtcttttaattggagcatttagtacatttacatgaatttgcagcagctggtactggttgttcctttccatgtttagcacttccttcaggagctcttttagggcaggcctggtggtgacaaaatctctcagcatttgcttgtctgtaaaggattttatttctccttcacttatgaagcttagtgtggctggatatgaaattctgggttgaaaattcttttctttaagaatgttgaatattggcccccactctcttctggcttgtagagtttctgccgagagatccgctgttagtctgatgggcttccctttgagggtaaccggacctttctctctggctgcccttaacattttttccttcatttcaactttggtgaatctgacaattatgtgtcttggagttgctcttctcgaggagtatctttgtggcgttctctttagttcctgaatctgaatgttggcctgccttgctagactggggaagttctcctggataatgtcctgcagagtgttttccaacttggttccattctccccatcactttcaggtacaccaatcagatgtagatttggtcttttcacatagtcccatatttcttggaggctttgctcgtttctttttattcttttttctctaaacttcacttctcgcttcatttcattcatttcatgttccatcgctgatactgcttcttccagttcatcgcattggctcctgaggcttctgcattcttcatgtagttctcgagccttggttttcagctccatcagctcctttaagcacttctctgtattggttattctagttatacattcttctaacttttttcaaagttttcaacttctttgcctttggtttgaatctcctcccattgctcggagtaatttgatcgtctgaagccttcttctctcagctcgtcaaagtcattttccgtccagcttccttccgttgctggtgaggagctgcgttcctttggaggaggagaggtgctctgctttttagagtttccagtttttctgctgttttttccccatctttgtggttttatctacttttggtctttgatgatggtgatgtacagatgggtttttggtgtggatgtcctttgtgtttgttagttttccttctaacagacaggaccctcagctgcaggtctgttggagtacccggccgtgtgaggtgtcagtctgcccctgccgtgtggtgcctcccagttaggctgcttgggggtcaggggtcagggacccactttaggaggcagtctgcccattctcagatctccagctgcgtgctgggagaaccactactcttcttcaaagttgtcagacagggacatttaaggctgcagaggttactgctgtctttttttgtctgtgccctgcccccagaggtggagcctacagaggcaggcaggtctccttgagctgtggtgggctccacccagttcaggtttcctggctgctttgtttacctaagcaagcctgggcaatggtgggcacccctccccgagctttgctgccgccttgcagtttgatctcatattgctgtgctagtaatcagcaggactccatgcgcatgcacgtaggcccctccaagccacgtgcaggatataatctcctggtgcgccgttttttaagacggttggaaaagcgtagtattcgggtgggagtgacccgattttccaggtgccctctgtcacccctttctttgactaggaaagggaactccctgaccccttgcacttcccaagtgaggcaatgcctcgccctgcttcggctcgtgcacggtgcgtggacccactgacctgcgcccactgtctggcactccctagtgagatgaacccggtacctcagatggaaatgcagaaatcacccgtcttctgcgtcgcttacgctgggagctgtagactggagctgttcctttttggccatcttggctcctccccctgtgttttgattcaatatattactagcacagagcagagaaagcactcaatatatattgatttaagtaaaattaatgattggataaaatagcttcactgtcacactatacatgacactgacatatgtctatgtatatctctatgtcaggagacagaaatataacagtatttccacattctattcatagtagaaatgaaaggcttgaaaaacccaggtattttaattccaaattttgtttacttttagcatctatctcttcccagcctactctgttgataatttttactcagacctatacacataaaaatgctagcatatgcacatacacataaaacacacaaacacagtctgcattgtcatttataattttgaaataaattaaagattctagaagtaattataattttataatatacatgttatatagaatatgatattgacaaacatcttctcttgaaacaatgttatgcttattgggaaaattataccatggatgtttccagggacaacaatatagatgccatgactggtgacatttaaagaatttgggtaatttaaaaaaaataatttttcttattttaaaattaatattctagctaagacaggtagcctatgtccagccctggcaaaactctggagttcaggataaacagaaggttatgccattatctggtggattttgacagtacaaaatatcaatagcttaggtggaaaatttttgatgaattcatttggaataattttccaagatttttcaaactaagttgaaattacaaaatatggtttttaaaataaaatgtttatgaagaattcttatgtcctggtcatagaaacaagtgatacttatgaggcctaaaattagtggataatatgtggcatgcaaacatatgggtaaaggacttttggattagaggaataaatgttagatctggtagaactaattggtaaattatcaacttgttattttacaatatagtttaaataacccataatatctgtttaaaattggagtatatttctgcaataatttatctcatcttaacatacaacctaacccttatccgtcagcatggtgatataggtcacaaggtttgcaaaatcacacaaaaagttttaaaattaataactctggcatactatccttaattcattctgttaggggatgtaaatcattttatttgagaaaaaaataatgtctgttgataattttctggaggctaactcacatttttgcatgttaattctcagcaaggaagtttctccccaatttactaaaatttctagtgacattttttctagagtttaacaaaattcacatcaacaaatgtgtcacttcttttgacaaacttttatcctatttatctcattctttatcctaggagttactgtgacataaaataaaatgctaacagagcaagtaaaatatcagggatgaatgactagtaacattatacaaggtttgataagccgactcaaacttgaagaggtggcagctcaaataataactgactgggcagcagaaacaaaatgattacagtcttccaaagggcaatatctactttcagggagaaaatgtgctaaacaatcctgattctaccatattatacttgagagaaaataatattttatttatcattatatctccagggcttaggacagaggcaatgttcaaaaaataattttaaaaagctttattttgaaaagctaatagctaatttaatgctatcttaatgttacatttattttcctaagaataagacattaaagtacctgaaaattcaaatttttgtttcttctgaaacaaatttcactttttttttgtttgttttgttttttgagacggagtcttgctcttgtcgcccaggctggagtgtagtggcgtgacctcggctcactgcaacctctgcctcccatgttcaagctattctcctacctcagccccctgagtctgagtagctgggactacaggcacccgccaccacgcccggttaatttttgtacttttagtagagacagcgtttgaccatgttggccaggctaatctcaaactcctgacccgggagatccgcacgcctcggcctcccaaagtgctaggattacaggcacgagccactgtgcccagccacaaatttcacattttttaaagcatagagttatgatatgccccatatgcctagcctttgattatgtgctcctttaccccatttcctaacgatttcattattggaattgtcccctcaaccagattttaaatttcagagtagatacagcgttttattagactcttcttctccatgttgtttggccaggtggggtgcatgtaatttagtttagatacattaggaacttaaaatagcaatatattgtttgtattattttaataataatgtcaatctcaggacaactgtacaaaagataccatatcctttagtgtttactagtcacagtcagagtattatttggataacttcttcaaggttcagaaggatatagcctcacaaattaaaatccaaatgcatagaaaagaattttatgacatctatactttatccttaacaatgacaaaatgaagccgggtgtcgtggctcacatctataatcccagcactttgggaggccgaggcgggcggatcatctgaggtcaggagttccagaccagcctgatcaacatggtgaaaccccatctctactaaaaaaaaaaaacaaaacaacaaaaaaatagccagccgtggtggtgcacacctgtaatcccagctactcgggaggctgaggcaggagaatggtcataaataaatgtaaagaggttcaatatacctaaaaatcaagaaatacgaattccaactattgggatccactattatttcatgattaaactatcttggctaaaatattgactctgccactcactagccatgtacaagttatttaatatttctggccttcatttttcctttttttcttctttatattagataaatgataactataattcacaataaaaatggaaagaactttagttactcagagtaataatagcagctacctaataaaaatatttgtaaataaaataaaattgtgcttctaaattgtctaaatgaaggcctggtatgtactaatcactcaacaaatgttagctattaataatgataaatcattccacggctatgagattaacaataataataatagtttaaaaagtaaagcaaacacaaaagaatgttgactgaagaggaattttaacgtcctgcattgaggaaaacttcgcatttttaaagtagaaattgtcaaaatatgtataagcatttatattacagtattgtttatatctattaaaaattagaaacaacactatgttggtatatacatgttataaaatacaacacaatagttaaagtgaataaacaaataaattaatgggaagactcatgcatttatctctcctttcttatatgaaacttattgtaggataacaaagtattttataaaatgttaggtaggaaggagcacgtgaatcagaatatcactgttttgcaacctttaataaaataataaatgttggtcgtggctgcaaacatcacagatagggcaacattctgatgtaagtacacaacaccacctatgatatagtcttgccaaaaaacaaccctgaatttcactactagtttataggaaataaaggggaaaaaggaacattttgaagttagcaaactccagatctcgagaaactctaaaggcaaatgagtaggtatctctaacgaataaatagctagggaagaagagaaaaagaaagaaacagagacacagagagacagagattgcttttagttctagatttagcttaaaatgtatttaaaatgtatctttaattctaattagaaaaaagctttaaattttttgaagaaagacaatccaaaaatttttaacattgagtatttgatgaaaataaataaatattcttaattattttgtgaacaataatatttttatatgttttaaatcctattatttttacagttatatattcaaacatttcataattaaattatattctatttgtgattatctttataaccatatggggcggtgagtttttatatggatgaaacaagaatacttaagcattgaaaattattattcccccctccccccacgccaacacaaattccctccacccccttaaccctgccccaggcggagtttcatgcttgttgcccaggctggaatactatggtgccatctcggctcactgcaacctccacctcccaggttcaggcgattctcctgcattagcctcccaagtagctgcaattacatgtgtgcaccaccacacccagctaatttttgtatttttagtagagacagggtttcaccatgttggtcagactggtcttgaactcctgacctcatgtgatccacccacccagcctccaaaagtgctaggattgcaggcatgagccaccatgccaggaccacattttattattattcttcttcttattattatacattaagttctagggtacatgtgcacaatgtgcaggtttgttacatatgtatacatgtgccatgttggtgtgctgcatccattaactcgtcatttacattaggtatatctcctaatgctttccctcccctctcccctcaccccacaacaggccccggtgtgtgatgttccccttcctgtgtccaagtgttctcattgttcaattcccacctatgagtgagaacattcggtgtttggttttttgttcttgcgatagtttgctgagaatgatggtttccagctcatccatgtccctacaaaggacatgaactcatccttttttttggctgcatagtattccatggtgtatatgtgccacattttcttaatccagtctattgttgatggacatttgggttggtgccaagtctttgctactgtgaatagtgccgcaataaacatacgtgtgcatgtgtctttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacatcctctccagcacctgttgtttcctgactttttaatgattgtcattccaattggtgtgagatggtatctcattgtggttttgatttgcatttctctgatggccagtgatgataagcattttttcatgtgtctgttggctgcataaatgtcttcttttgagaagtgtctgttcatatccttcgcccactttttgatggggttgtttgtttttttcttgtaaatttgtttgagttcattgtagattctggatattagccctttgacagatgagtagattgcaaaaattttctcccattctgtaggttgcctgttcactctgatggtagtttcttttgctgtgtagaagctctttagttttaattagattccgtttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaagaaagggatccagtttcagctttctacatatggctagccagttttcccagcaccatttattaaatagggaatcctttccccattgcttgtttttctcaggtttgtcaaagatcagatggttgtagatgtgtggtattatttctgagggctctgctcctttccattggtctatatctctgttttggtaccagtaacatgccgttttggttgctgtagccttgtagtatagtttgaagtcaggtagcgtgatgcctcccgctttgttcttttggcttaggattgacttggcaaaggaattgaaaattattgaagctggagaagggtaaattataacattctatttttgaagacattttaaggttttcattaaaatctggatgcatatatatttagttaaaaaatgaaaatgccaactagaaaagcacacatatggaagcttagtttattaatatttttcatatataaatatacatgcatataggtatatgtaaatatataaatacacacacatccatgttggaggctattcataatatttttatcatattcaaatactggtattatttttcatcagtctaatatgactctggacacctatcagaaataaggaacattagctaatcaagcttgcctcaatatgttattatcctgacataataaaggtatcattatatcttggtaagttcaaatgtaaataattcaaagtgcaatcttgcttgccttctccttgctgatgtaacaaggatagtatagttatgttcactagaatgaaataaaatcggcatttcttctttatattagataaatgataactgtaattcacaataaaaattaaaagaactttagttacagattacatttatctgctaaaatatatctcaaacttagattgtaaaatgatcatttttcttgtttaagacccaagaaacatttcagaaattaattatggtattgtcatgcttcaagtgcatatgttcttaagacaacttacatgctttaccctgggagtctatgaacaaccacattttcttatctgtcagctaaatcagagacaccatctaccagatgactcataccagcaatttagaaaataaaatccacctcaaatttggtcttcaatttaaaatttcttgaaagtgtaatgttacctcatcaaaatattaaataacaactgaccacattattccatgtctgtacctctgttttctaggattttttaatttaataaaaaatttaaaaatgcaaaacacaaatgcaaactgggttacaaaataaaaataaaaaatgaaaaacacaaatgcaaactgggttcatcaataagagaggaaattaccactcggatgtatttcttaattttttattttgctttgtattgctatttttattcatgactaggaaaggctttaaagcctctccttcaggaaaaattgtttgcctaaaagtacagctctgtatggagatctgaattttattactaaatcatttgttattctttttattcatttgatattaatcttgattattgtatcataaaagctcactgagaataggaaattcatgttaattctaaagaaacatcattaatatatttataacaaaaatgttatgcatttagtggcctcaaacctgcatactaaaagtgacatttcttaatggaaagaaaaattccactgtcaccagcaacagtaaagagatatattgtatactgttaataataagaattcacagggccattagttgaaagactagagggatagaatacaatatcaatttgtagaaggaatgtttcacagcaagtcaattagaacagaaattatgtcacaaagcttgttttttaatagcatatagatattagcatgttttacatatgttttttaaactaggtaggaaatttagatttcccattaacatggacaacaatcctgtgaacgactgctcagcttatgtggtactccatagtctctgcccttttccttccctttccatcttgcctatctattggagaggaacacagccaagttccaattcatcactgctatacacagtttccatgcaatgctgccactggcaccaactccctccatctggccttagtctgagcatggtttcctctacaactgttgccagtctgttgccatagcagcagctaagaggactatgacaggatgggaaaagaataaagcacactccattttcatgcttcttgttgagattttgtaatggttccaaggtcccactaaaactatgatggaaaaaataaaaacagcttcaccaaagatacaataaacatccttttcaaagagaaataacagtatataaatgagaaacattgaagcctgcaaattgagaataaaggagcacacacacatggtcagaaggtgacccacggattacacgaatatcaaattatgaaaataataaaggataatttttaggtctttgttaatgaaagattagaaagacaagctataaacaaacatgttagatcagtgtttggaaattcttattaatgaaaaatctgcagtaattccttaaatagctacatcaatatttgaataaatataaaggtaagcattttctaggtagtttattataattccatgataaaaatcattacctatgtttctgacttaaagagacatataacattatatgtgtgcaggaaaatacatcttatctgaatttcaccaaaaacttattttaattctataaattctgaagattatcatatatatacacaaatattgtctacaaaaaggcaacttaccataaacaaaagcactgaaaattaaaggacaataaaaatcaatgaattctaatcttaagcttaaaagcctactgtgaaagcttttggcaaatagaaatattactaactcttaaggttcatgtgatgaatattgaattggaaatgtatgtgaaaagttcatcatatttttctccattctccaagtacgattacagaaaattcccaaaggccactgtatcttacttttgaaaccataaggagttagattacaccacctgttttacaatccaggctatcctcaatgttcacaattttcacctgtttgtaactgaaaaccaaaaggagttagattacaccacctgttttacaatccatgctaggctcaatgttcacaattttcacctgtttataattaaagctcatggtgagcttcagctcaccaacatttcctcaaatatttagtattatctctgcttctatactcaaacattaggcactgtcttttctgggaaaaaaatagggaaagaaaagacaaagggtatgtcctacttataatcatgccactgaaaagcttcaaaactcagggcactctcaatgaaaaaaactgacattttcaagcatctcatttcaagtcagacttttctatatagaatgtctgtgatgtaatatcaaccaataatataaagcttcctaataaaaaagattgttttaaatttatgatagatacatttgaaacagatgatgcaagtaggctatattgtattatttagtttgataaactaatagataaaaccacaaagttgtgcccaagggtttggcttccaggttgaaaccttgtgaaagccaaacaagctaagcctggtgaacaaatggttttcatcatcatttttattcgccataattcaatttatcctactattcagcctgcttgtaaaaaataccactattatagtcaagtctgcaaatatttactaagttcttaccctgcccaaagcacatgagtaaaataatgattttccttactttcaagtcctttaaacatgactgatacacaacatgcttccttctttgagcattacaaatgattactggtaaggttggtgtttaacatgtcagcattgtatcattttctgctaaatcgatcttgttcatttgtaactaggagtgcacctcatagcagagcggagagattgccacataatatctcagaggcgaaaataattcaagagattttgttgtgccagggagttagacacatttatgctctttgggttatgtagagctgtatgataaagtagatgatatgtctttataaacttacacatttaactatatatgctcacaggctgaggaggagagaaaaataaagggaaaaaaaagcatttgaatagtgcagaagacttcagtcaccaccacattctaagcctgcatgctgcaggttgagcatgaactgcactcatgaaagttcagattcttctcagtttctgtgttcctccaacagtaggagcatctcagtgggccatgtgtgattccagtgtttaaagataggacttcatttaaaatgctcccaaaattcaatccaattatgtcaactcattttcaactaggagagactgatatattctaatttgagaggagagacgggctacgttggagctattgacagatatagccagtatgtggctgttatgaatattttcaaggaattttttttcactataacaagatgcaatttagaatctaaagaatatcattgaaatacattttgttgtggaacaagtaattattcttcaggcctcacatggcctcgttcaaataccatccaggccatacagcaaagctgtgtttttgattccaaaaatcatcatggaaacttctgatcattaatctagatcccctgctacctgaataagtagaaggaattccccagatattagacactaaaattatcctctctcaaatggactatcatccatgtaaattaacaaaattgaattataccaaacacttcacatccgacatcattttggcaaataataataacacttgaatgaaaagacaacctgtcttcaagagcttatggtctatccaaaaaatggtatgacttgatatcagatggaaagtttgtaggaggttctccagaagcatatatgaaggagtgactaacaccatatacatacataagagaaaatttcccccaaaaggtaagtgttcagatgagtcttcctaaacaattatgagatttccatgcagataataagaagtgaagaacatttttttcagaaacatgaatgtgcgtatgacacaagaattgaattgagtgttcaggaacattctattatatgactagagtatcgactcaatagggctggggcttgttaacttgttcattttcaaattccctcctagctcctactatagagtccggctcacacagaatgcttaatcaatctttatttgattagaggtaagtgtctggaacacataatcatctgaagtgggtataccaaatatagtgagaattaggctggagtgtaatttgacaggaaatattaaatgaaaaatgattagaagagaaaattttactcctctctcgtttaagttttggcatcccagccctgttttgatgactaactgaagaatgaggacctgattctaccatgttgtcaaactgctctgtgttctgccatcatgtccacattccaggtgggcaaaagaagaaaggagtagaagaagggtatgtctcctccatttaagaacaaaaaaagttacttaatgatatctgttatatcccatcctcaatagctgtcacatctgactctagggaccttagaaatgttgagtttattgttggtgtccatatccagttaatatttagtggccctattaaagggaacaaaatacaaaataaacactgggggaaattagcaatctctttctcccattttaatggattttgaatttcatcatgtaggtaatatgatgtaagcagttacttaggttaatgataaatttttaactttataaaagttaataacacctccagtagcaatgagtatacccagtacctagatgatggtttctaatgccattctccatgagctctccatggccaaaaatgaaacaagttaagaaacaaaataaataatgtattattagaatataagccaaagtataaaataaatttccatgagtccattataatataaataaatgattgaatcaagagataaatggaataaaaatatcctgtgcagaagaattccaaataagttacgtaggtacactcccctaaggaagatggagtaaacttccaacccattaagtgtacgctgcatgtagtgacttccttccaagatacaatatggtaagtggagaaaaagataaacattatggtagataaatctgagaaacacaccctcagccagatgatgaaggttaacttcaatgatatgtaatattcagagaatgtacccttgatatgaatgtttaattagagaatggtatattacttctgtggcttttctcccaaagacttacaacccctttgtaacaatacaaaaatcagacaaacctaatttaatgacattttatataacagcttcttcaaactgtcaaggtcataaaaattaaggaaagtcagagaaaatgttagttaaaaggagcctaaggagacatgaggacttaatgtaatgtggtttttggttgggatcccagaagagaaagaggacgttagactaaaaaactaagcaatatgaataaaagtatgagcttcagttaaaaataatctatcagtattggttcgttagttcgtcagatgtatcagagtaagatgttaataaatagaagaaactatgcacagtatatgaaaactatatttacacatttttggcaaatataaaactattacaaattaaaagtttacttgaaaagttataatgctcaatgtaataagttctacaaaaggaagtagtatttagttcatggcccttaaagttaaggataagattattcatctttatataacttactaccatcctgtaaggctctgtgtgagcaactagccagcttttctagctggattccttctatcgtcactttctatttacaaaaccctattttaactctcataaatttgagaataaaagtatttcaatcacatttaattcattttacatattccactagtcaaaataattttttccaaaatgctatttgctaggaacactgtaatgtcttctgaaaacttagtgatcttgtcttctggaatatggtatggttaatgaagtctaaagtgctaaaaaataagttgaacagcacttatgtcagatgtaactcatctttttactttttttctagttgaggaattaactaatttcaggctcaaatattagaaagctggccccatagggctactttccagacctaactagttattaacagattagtatgtataaaaaatattttattggtaatcatctagtcaataatttaaatatagattacataatctacttttttctaagaaaataatttttaaaaaatcctgccccatgaatatttttatttatttatttgttgaattggcattctttaaaaaaatattactctagaggacaatgcccaggtcatggtgtggcactgaattccacagtagccacggttacattgttgaaaagattctacatgagcacactctgaatcatacagaggaattcagaagataagataaaatacaaaatgtgattagaaatactacccagttgtaccaacttaaagtaaagcaagcttgatttaccaaaatataaacaagtaaacctgatggaaatgaaaggcaaatatgaggtttttagatagagtgaagtaatatttaatagaaaaaaatctttatttatcaacgcccatttactaagttccaactcacgccagagcccgactttaaaaattaataaagtacatctccatattttaataatgtacagttctggtgaaatatggagacataaaaacacaacattataacataaagttgattatatttcgaagacacccatagggcgttaaggacacatatgcacaatacacatatggcaaaacccctagattttggcattaccagtaaacataaatacatcgagaaagtaactgaaatttaaattttgcaaaagaatagtgaatcaaatatattacctacgtctgttttagaaaagggaattatttatgataaaacaaaaggtaaaatcataatacatataactctgaagaagcctagaatgagagctcataggaaagttacatgatgttaaagaagaaggaggggtgcaggaaggtatgaaagaaatatgtaaaaaacacattttcctcatgataaattatagaatcaagataattcctacctacattaaggaaactccattcaaaggtataaaccatcaaagccagacaaagtagttatatagaccaggcctggactggcattggtccctggactgttaggaactgggttgcatggcctgtggtaagtggcaggtgagcaagcaccacctgagctctgcctcctgttagaacagcagtggcatgtgattctcacaggagcgttaaacctattgtgaactgcacttgcaaggaatctaggttgcacgttacccttatgagaatctaatgcttgattatctaaggtggaacagtttcatcctgaaaccattgccccacccctgactgtggaaaaattgttttccatgagaccagtccctggtgacaaaaaggttggggactgtggctatagccccattatctataaagcctcatagatttcagacccacattaaggtagatacatgaaatttagaaatttgcaagaatttccataatgataaacatttttaaaaggacataaactgtccaaatgtaaggggataccaagggacaagaagaaaacatcaagcactgatcaacctcttgttattttctttgctgataagttttcacctgctaatttttccctgaaagttataggatagaaactatacgtcaaagaaaggttaacagtgggaacatcctaagaccaatgggcagtcttagaatacattgaatgaaatttctcaaaatttcttctccttattttctgagtttaaaaaagccataacaatttatatatccatatatcctatgaattctgattgaaaacctaatgctattatttaacattattaggaaataatatccttatttttaaaagtctacctcaaacacattgcgctgtctttcctaatatttcattattgccacaatcatcccttatgtgaatcatgaaaataacctccaaagccgtctcttccaatatttctctgctctaatcccacaatctggctgtagccagacaatcttattaaaatactgactggatcatgtaattcaaaacctttaaggactactcttcaaataaaaattaagaccaaatttcttgccgagttcaaaacctggtacaaatagttccaattctatttttcaataattttacatttatttctacctcaatgtttaagcgttctttatccgaaaaccaaccttcccaaaatttgttcctgcttgttgatctgaccacactgaagtgatcttggcctcatcctgcctcagcttggaatttctactcatctctcagaatacacctacagaggaaaccttttcaataaagccatgaacagaatacacatttggcaaatgttcatgggattaatttgaaacctgtttagggtatttagtctacgaaactcatgacaaaaaacatccagactttacttgaatatttctgaactaatttactacttcatgaggcattcattgcaaatatttttttctttctgttgaattgaaatttgtcttctggaaatttcaatccttctatcctaaaaatcctgctttaatttgagtgtttttagatgtttttattaatttttattggtaatatgctttcttatttatttcttaattattatgataatttagagataagaactatacaactagatgtatgcctacaaaactttttcatgatatatagaccctatgtgcacagttttcattttaacatatcgaggacagaagaaaaatcacagctgatgttaaaatatgtgataactgctgctacacttctacatcagattctgagaagtccatcaagctgtaataggttttctttttttcttatagataaccaaattacttgcccaaagaagctctcattatcagaaggtatactataatacttaactacatagtatcaaactaggaaacctaaaaaacttagcgtttttacccaaaagcatcaataaagtcactgttgaaattgctgaactctcatttattcattcaacaattgcttactgaatatttgttgatgtcttagagaaacatgaacaaaatcatgtagcaataagtaccattcaattcaattcaaaatgtattacacttttattctatgcaaaccactgtcttaactaaagagataccaaatttatcttcatagttgttatcacataccaggaatgccaagtatataagttataacaggttggctcatgtacaaataaatagagtattcctgcaatgataccataagaaaatgaggctacaattctactaacgtcccacatagagagaatatagacacagttcacctgtccatccagctactttatacccaacctataaccacattatgaaacatcatatcttttcagattctaagaatgcctgctactggtttcatgacaaacatataaactttgaattgcaacttaaaaaaatgtcaaaattatcccacaggataaaataaaatataaacccatcaaaatgctgtattaaatctaccaccaaaaatgcctctttcttttcaggaaaaaatacaaaactgtgatccacagagaatgaccctttctgatatgtatacatgcatgtcaacttttaattcatgattctaaattgagaaacctcaaacagctatttttaatatcccagccctattcttattttgcatttatatccatcatatatctcaaccagtgttattgtttattgtatcattacacaaatacatagatcatttccatgtttgctcttttggaaggggtttcctcaatggagttgacttatcctccaaatttgacccattcttttaggcccagttcacatcttctctccttctagcccttacctccctgtttaaacattgaacacttttttctccttaaactactagagtacttgtattctggagtaaaacttttgaaatttgattaaatacagtgtaccatccatatccccagaagaacagtttatataaagtgatgtatattttaaaaagctaactttttaaagaaagaaataagaagtgatattttcttcttttgtttctctttttcttctagtcctttcagtagttctttggaatgcaaggataagatagacaatattcataaataaaacttcctccaattaaaatatgccataatttgaatttggcaaattagtttgtggtattagatatatttttgtaactctattggaaattattttcctggttttataaactgctctcaactttgtcaactccaggattaactgcatattgatccttagaatagtccaccatagaaaaatttgattaataagccaaagctaattgtgtctctgaatattttttattgtcttgaggattactgaagtctctcttatactttgtatttgatcagacttggtatcttattaaatattattagttcatactgtcttattacagccagagtccactatgcatttaaaattatgatgttcttcatatcatgtcccatatattatagatgttaacttattagttatctcattgaagtaaaaaaaattcttctgctaagtttctcaggataatattcaggagcagaagtctgcagactctagacacagttccttctttattgatttatgcataaagagaatcataggactttgtggaaaactgtgttaggaaaaaaattgtaagactgctttgagcctttattgacatattctgaaggctttgatttcataaatgctaacaagccataagtataagttgtgtgactttaatacagactcctggatattgatagttattaagaacctgcaccataattaaaccacgatagtcagaacagacaggaataatctctaatcagacacaatttctagtggggtaaaaatgggaatacattcatactactcccttatttttacttctttattaataaattgattctactttttggatgagtttgtttcatggcttcctttgatccccacgctatccccatcatacacacacatatgcatgtataaatattcatgcatacattcatattgtagaaaacaaaaagatattttcctacgtatacattatcacatagcctcaaatctgatcttctgtggcagagattgtattcccaatttccccttaaaaaaaaaaaaaaaaaaaaaaaacatgatttcactggggtcagaacattgccaagataaaaaagctgtatttcccacccatccttataaatagaaatgtccgtgtgatgtcagtcaaaatatcggctttgagcttccaaggaggttgactcaaatagtctataccctattaccattggttcttcatcttttcttctttttgaagaaaaaactacctgaattacagcaaagatcttgtaaaaataagaacaagaaccacaacctgaaaattgtggcaaagaaagctaaaaggacatgataatatccccaatgaaatgatgttgtccccataccagcttcttatggcctatctttgggcttctctttatttggaaaaaagcaaatcaaaaatcaatttttagccactgtaatataagttacttgctatatgtagtccactgcaattcctactaatacacctcctaaattttgtcagaaataagaatttcagataaatgaatgctaaaattgaagcaatcaattgtggttgatgacatttcacatttaactggctcacagctaaaaggtgcaaagtgtaagttaatttattgatttgcccagagtgatagactgaaacaactttatcttagaggatttaccgggaggttacatcacttcagattactgaaaccatagtctatgatgtacaacatttggcacatcaatcatttatttgcatcagagtagactctaaattgttgtgggcaaaatcttgactttgtttttgggcattccatggttccatatctaccaagcagtatgagaggcctctctttaaactcatgtctccatcagtctccccacattgttcaagatgtcagctcctgggcagaagcatggtggtgtggcagcctgatcacaggactggcaggatcatgctggctactaggaagaatctcctgatggcacagggatgactgggggtctgagtaagataagcagaaattggaataagataagcaggttatattgagagtgcaggaaacctaagatatgcacagcctgaggaggaggcccaacgacgtaaatactgtgaccctgatagaagagaccatttgatggacaatcccttcaggggctgaagagaatcaaaatggaatgtgaagaaagattaaaacaaatgaaaaattcatcctgggggtcatttttcatcagaaaacaacagaaagaatacagttagataatgaagttctttcagccagtaatttgttgaaaagagggaagggaatcttagcatatggggaccaaaaagtaaacctgaagaaattagaaaactctgtattactatccagaaaacaactgagtttcctaagctaagaaaaactttaaaaatgccttcatataagatctcagcagcccaaaggtactgatgtaaaaggtatttatatacatataaaatgtgcatatatatacataaatatataaaatttaaaacaaatatatataattttcacagagggccctaagaccattttggtagctgattgccagaacaaaaagagggccatcaaaatcaagttatgctagcataaattatggccatatatattaattataggaatcacaaccaattttattagaaggaatttaatgcttacatttgaacaacaacaacaacaaaaagtctggctactgggaaatgagaatctgagttttctcctcctaagtaatcaagataatgagaagatcacagaccactacaatgagaagttcaagaagatgatcaggtaacactgagagaagcttgtggatcctgaaaactgtgtttattgtttacattgataagtataggatatactctaaatcaaacacacaaacatacacacactgtcctttctagaggcctgctaattttttagtagataagtccgaaaagtaggccatagtagttctactttttacatgctgggatctgtgatattgaatttgtaatattttgagaaaaaaacaatgtgcagttttctcaaaatgacaagcagtgagtattgtgtttacttcccactaacatgttttccccctcagtcaacaaaaagaaatatatgtagggtgtgagattttatcacatcaatttttaaaaactatttattcaataatgtctttcattccaaatagcatgagattttgagtctcattattcatagaatctcattattcattgaaacctgtcttggaaaatctaagagggaccaaaaggaaaattttattttctgtcttttacaaacttgctgtattcattcattttaaaatgtatttttttttttaccattttagctcttatttgttaaacataaaataaacttaaccaggtagttaaaaatatttataggtgatttttacctaataattaggttggctttctataaaaacatgtgtttacccataagagttgacaacagttatctgcattcttagtacctgtaagacttgaattcattgccacaaaatactgatcaaaatcttagtggataaaaataatatttatgtataacatttatgaataaagatatgggcattaatcactatattatcaaaagtataagcagttcacatatgtgtgcttaggttggtccattctgtcacagtacctcatctatattgttttgcttagcctgctcccattggagtaatctttattgaacattatttgggcattactgcattggtcatatgagaatgtggcacaaaaagtcttaggaaactcatttttaattatctttaggagcatattgaaagcattgttcattgcatgacatgcttatctcttcatagggattaattggaaattaatatttgcatctgctccagtctcagtctttggaatatgtgtatatcacctagtaattggtttgtatttaacttatggacactgatttatgcaacttgtcttatttagccttcccattgtctgttacatagcacagaactgtatttgttatccacctagtgccagtacattgcaaattataatatttcatgtattaatcttattttcatgttcactttccctgaccctattatcttttgaatttctttacatattaattttaatattattctatgatgcttattttattaactatccaaagtttctcttttgtaaacaaggcagtatatagcagcatcttaaaaataaacattcatctatgcattcatttggtaagtatatattgaggacttacattatggcagagcctgtataaagtgctggttttacaatggagaataagcagcttcaaggaacttcttttagagatgaaaagacatactactcaggcaagtcattataatataatataagtgttatcacatgtacaatgtccagtagtagcataaaggataaacaagtctcttttagaagacagatgctgtatcagtcatggccctgccaagaaaagcacgtcatatgcaaaccagctactttcctaagaggtttttttttttgtttttttggctttttaaaaaattattttaaagggcctgggaaagatttagtaagagatgacatagatccttgaggcttgtaccatctgggagcccttgaacacttggacctgaagagacgaaaagagaggttcaggaatccaaagaagataaatatatagagagagcaccctaaaggagagtgaaaccaaccctctttgcaaagagggagccaagaaaacaaaggctctgaactcccttgcaaccttctcttcttctagcttctggcgcctcccattggccaaacttaacatgaagccacagagaaagtgtattagtttccaagggctatggtaccacagactagatagatttgaacaacagaaatttattgtatcacagttctggaggctagtagtctgaaatcaaggtatcagcaaggttggtttcttgtgaggtttgtgaggaaaaatctgttccatgcctttctcctacattctggtagcctcagaaattgcttggcttgtagatggcattatgtcttttcatatcatcttcccttctttcatctgtgtctttgtgtccaaatcaaatgcttttattaggataccagtcatgctggattagaacccatgccaatgacctcattttaacctgattacctctgttatgaccctatttccaaatagggtcgcatgctgaagtactaggattgagtacttcaccatatcttttgcagggaggggataaaattaacccataacagcaaggagttccagtaatgtggtctaaatattaaataacgttataatataacttattatcagcaaagatacagctccacagttttcactaatcattaatcagctatgttattaaataagggaattattatgtttggtagaataattttacagaacattagggtaaagacttccaatttaactaaaactcagaaggttttaagaatattctagagtcttacttgttatagatgagattgatttagtcagtttaaatcgttcttaaattttaaaacactataaactaaatgactttgcaattttattcaactgtatgtttctgtttcttacctaatagtcatgtatcttacctaataacctatagttagaaaccttgattttattccacttctttaaaatatagaaatttactttcttaacagtatttctaattttattcccctaagttgttaaaaaaagtcatgtatccagaattacttttgctgttattaccgtcagcttcattttaagctatacacttaaacttactgtgtaaataattaaatgtatgtggtcattttcataggttatagaaatgatcattaaaacctttgttcaaaatcaccatgtgaaaaactagtgtcagatttactgatttgaattaaattatgcattgagtttcaaacctgtgcaaaatgaaagcacagtatggccctcagcatcaatctcaacacacaaacattcatcagtactatacccctacaattacttagaaggaaatgtaatttgaagcaaaaattaatcttacttaaattgcctgcagttttacccaaaagatactctgacttagtagaaatccttaaaatgtaagtctcttttctttttttttttttgttttgttttgttttgcaatctgaaaaatagcttttattttgcactaataaaaccatcaaaaaatatcttttggaaacgacaactctgctttgaattgacaacatagaccaggggctggtcaaccacagcttctctatcacatccatcctgctgcttgttttcctaaatagttgaaacacgctcatgtcatttatttacatattgtccaagtctgctttcacatctttttttttccttttttaaattttattattactatactttaagttttagggtacatgtgcacaatgtgcaggttagttacatatgtatacatgtgccatgctagtgtgctgcacccatcaactcgtcatttagcattaggtatatctcctaaggccatccctccccactccccccaccccacaacagtccccagagtgtgatgttccccttcctgtgtccatgtgttctcattgttcaattcccacctatgagtgagaacatgtggtgtttggttttttgtccttgtgatagtttactgagaatgatgatttccaatttcatccatgttcctacaaaggacatgaactcatcatttcttatggctgcgtagtattccatagtgtatatgtgccacattttcttaatccagtatatcattgttggacatttgggttggttcccagtctttgctattgtgaatagtgccacaataaacatacgtgtgcatgtgtctttatagcagcatgatttatagtcctttgggtatatactcagtaatgggatggctgggtcaaatggtatttctagttctagatccctgaggaatcgccacactgacttccacaatggttgaactagtttacagtcccaccaacagtgtaaaagtgttcctatttctccacatactctccagcacctgttgtttcctgactttttaaatgattgccattctaactggtgtgagatggtatctcattgtggttttgatttgcatttctctgatggccagtgatggtgagcattttttcatgtgttttttggctgcataaatgtcttcttttgagaggtgtctgttcatgtccttcgcccactttttgatgggtttgtttgcttttttcttgtaaatttctttgagttcattgtagatcctggatattagccctttgtcagatgaataggttgcgaaaattttctcccattttgtaggttgcctgttcactctgatagtagtttcttttgctgtgcagaagctctttagtttaattagatcccatttgtcaattttggcttttgttgccattgcttttggggttttggacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctatacatggctagccagttttcccagcaccatttattaaatagggaatcctttcgccatttcttgtttttctcaggtttgtcaaagatcagatagttgtagatacgtggcgttatttctgagggctctgttctgttccattgatctatatctctgttttgctaccagtactatgctgttttggttactgtagccttgtagtatagtttgaagtcaggtagcgtgatgcctcccgctttgttcttttggcttaggattgacttggcgatgagggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatgaaatgttcttccatttgtatcctcttttatttcattgagcagtggtttgtagttctccttgaagaggtccttcatgtcccttgtaagttggattcctaggtattttattctctttgaagcaattgtgaatgggcgttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacagtcatgtcatctgcaaacagggacaatttgacttcctcttttcctaattgaataccctttatttccttctcctgtccaattgccctggccagaacttccaacactatgttgaataggagtggtgagagagggcatctctgtcttgtggtagttttcaaagggaatgcttccagtttttgcccattcagtatgatattggctgtgggtttgtcataaatagctcttattattttgagatacgtcccatcaatacctaatttattgagagtttttagcatgaagggctgttgaattttgtcaaaggccttttctgcctctattgagataatcgtggtttttgtctttggttctgtttatatgctggattacatttattgatttgcgtacattgaaccagccttacatcccagggatgaagcccagttgatcatcttttcattagcaaattgagaaaaaaattatttaagacaatgaacacttagtatcctaattttaataaaggtaagatttttcctaacttaaaaagcaaacatacaaagtattatagtttctttgtaagatattagacttgtaaaagaaaattatctttgtctgcaatgaatatacaaagaaaaactgggtaacattttattttgcctttaatttagacatggtttaatatcgacatcaaataagtatgataaaatgaatataaatataattattttatatactaattaatatattccgtctgtacaaatccaattgcttctttaaattctattttaaataagaacaaaatagggagtaataaataaataaaaagcaaattaaatgtttaaaattatgattaccccaaactaagttcaagtaaacattattgctccattctgcaaatgagaaataggaggatgagagagaaagtaattgatttgccccagtctacagaattagtcacctacatacagtagaatttaagtccactgctacactgctctgcctcagtgctcactataatatttagtttaggtcttcttagggactgcatgtttatgtgcctgaaattcatgtgttggggccctaacacccaatacaatagcattaggtggtgagtgccttgagaagtaattaggtcaaggtgatagagccctcataatgggattagtgtccttataagaaaagaaggagagctaaccctttctagccccttctctttccaccaggtgagaatacagtgagaagttggcagtcggcaaaccaaaagaggcccctcaccagaacctcaccatgttggtaccctgatcttagacttccaccctccacaactgcaaaaaataaatgtgtgttatttataagccacccactgtgtggtaatttgttagagcggcccagattgactaagacatgtcggctaactcagtgaatcaaaaaatttactataaaatagcagattctaattcccagtttttgtcaaccatgtttcccactgttgaggtcatttgagtttctcctttgagtttctatactagtgcttaccttacataggaaggataagggagactcctttatccttcctaaactaaactccctgggagacaacagtgagtggccactgtttacttcacactggttccagtttcagccactggccttcggccttcatgcacttttcatcctgataacctgtctagtgcctcttaggacctgcactctctacctttctcttatctgtcccaatcccactacttcctctattcaaaactagtttcctgtcccttctgtgcctactgacccagccaaagagtgttctgaggataactacttgttctgaaccttgggtttggagaaatccttttttctagagatatcacttattttggtttttccattgctcctatcttgcagatacacagtgcaactactaagctagatttccttctcctggggcctagagctggggatttcatgtcaacctctcctgtactgccaatccacttgagctctctttctcagatacttatcctcatattgtaatccttgctttaggttctggtctgttctgagccaagctaccatgctcagccacagaagctgatagcatgttatcagcttaattacccctgccacacagaggtatgctccatcttatttcctccaatttgcaaagaaggaaagggaagccaattaaaatgtctatgaactaacttgggtttcagtcgtctatcagaaatctttcctttccttccttctctgcccatcattctcattctctctctcttttctccctctttctctctctctctctctctgtctctctcacacacactgacattcacatcctttcctacacagactgagatagatactattcttttgagcccagaaacttccttcacattttaaatgtctcttctcatctatctctctgaatagaatgcgaggggactgaaggcagaaagaacatgttatattaatttttttatatcttcatttgcatggcgtatagtacagagtcaataaatgtttagtggtttaaatttctgaaggtgacatggccagtaatggtggagataggatctaaacagaagcttataccatgttatcatcagcttaatcacccctgccacacagaggtatgctccatcttatttcctccaatttgcaaagaaggaaagggaagccaattaaaaagtctatgaactaacttgggtttcagttgtctatcagaaatctttcctttccttccttctctgcccatcattctcattctctctctcttttctctctctttctctctctctctctgtctctctcccatcattctcattctctctctcttttctctctctttctctctctctctgtctctctctcacacactgacattcacatcctttcctacacagactgagatagatactcttcttttgagcccagaaacttccttcacattttaaacgtctcttttctcatctatccctctgaatagaatgcgaggggactgaaggcagacagaacatgttgtattaatttttttatattttcatttgcatggcatatagtacagagtcaataaatgtttagtggtttaaatttctgaaggtgacatggtcagtaatgatggagatgggatctaaaccaaactgtgtctgattctaaatttagggttttttttttttttaaacccaaaaatactctatagtcctaggggaaaaataaatattaaattaaaaataaaatcaataagtttgctttagttccatttatttatttaccaatagaaggagggttactctggtgtcttaatcttgtaagtaaatttagggtaagcaatgaaaatctttattctcagagtattctcaaacttattagactaaaagatgaactttttaagcaatctgatataataatatattctggaagaatacttttccttcaaatatctgtctgacctaacttccctaaatcctactattactgatgtgtacttataaattaaggttctctgttctgagattcatctattaatattcttgtgaataatatcactaatagcttatatttcatatatttagtgttttagagttatatagcaagtatttcaccctagggctgactagtagcctgtatgcaccattactatagaccaaatagttttcattgttgagttttactggttgataacatattttgattaatatcgcttctgacaaagaatttttcattttgatttttggttatttgaaaaagcttaagaggagggaaaagcagacctcattataccagttttatcaatatggaattcagatctcaaggagatgaagtaaccttccaaagcagcatattaactatgctgcttaataaatcttaaaaatatataagcaaaaatctccaaaaagagaaaacagaaagatatccccaaaaattgtccctttccaaattttgccttaacccccacactatcttcaaaatctatgaactctgacaagataattcttccaaaatgtctttgcttgtgattttgagtctcaatcataagaaaaatatagaccatgtcattaaaattgaaagtatatgttctaaaggcaaatctaattggcaaaataattaaagatcacaggcatgattaggaaagtaaagacaagtagaatttagtgaagttgcccttagctttatggaattcaaaagtttaatagagacaaatgtggcaagaaatatcctactcttatgatgaattaaaacacagtaaagactggcatctacttttgagctttaaaataaaaagcaggtattttcctccttcattccagtggcattaatgctttttaaagttctcaagatcctttttcattcagcataaagaagaaaaagaagttcactgttatctattaacatattgtttttatctggttcaatgcatccaagaacacctttcctaaacatgtctttgttttactacacactaactaaaaataaagcagaatacactgtctccctccctcatgccaccactttattctttcaatatttatgagctaattagtccctaattaggtaaataataaataatgacggcaaatcagagcccaggtaaagcccaattttcatgatttcattaaacaattaagaagtagaaactagcatgagttcttggtggaggtttattctaatagtgattctgtctgatgtattttatctgaaaagcaggctcctgctcacctaaaatatgtcaaagtaataaggaaatattgtgtaatctgcagggaaggcgttagaaattaatgatgactctggaaaaatctagaaatcaggagtgtgtagaaaccaagtcattttgatcaaatccaaatggtgtctttggcggaataccaaattaaaatagacaaaatgaaaagtacccacttgaatttaaaaacagatgaacataaatattttctcaaaagttaaggtcttaaggaaatctagtattccccacagctgtcaatcacttttgatgtttcattatgaagatttactttttgcaattttacagcaccatcaattgcaaataatcaattataaatctctttgttttcaaaactgggtttatctttaatattttctacaaatttgccaaattatcccaaaccaaaggtgataaattatagatgtgacagttttacagtattgtgtggttattttagattcctcataataaagatatgtaacatgcttctggattttcctgtttttcacatatttaatttcttcttatctgtatttctatgtctaatctgttaaacataatagagacgaattaagacaaaattctgcaaacaaagcaagactgacctagaagtcagagtatttgggttgagttttgactccagtgattacggaatctgtaaccaggtaaggcttttgcttctcagctctttttttcagagcagtgaggcaaatcaggtgccactcctaaatcatgggcttaactcatgtttgaaaacactttataaatcatacagcactgaacacactaaaacaaaaataaacagaagcctgccttaagtgacattgtacaacagcaacacaacattagctttcagtaaacctgagcaaatttaaattttttaatatgtcactttgtggcttggggaaatgattgtgtttttatatatatatatatacatatatagtttttttttttaaaataaagggtgcttttttgagtggcaaaactattggctattacacaattagtaaggactatacattaggcactttatgatgtttcatagttacagaatcctaatatgaattctaagaacaaatattttggggtaaaattttagccaatgaacctcttaggttcttggcttccaagataattatgatctaaagaatactcttcatgctcatactaaggacctttcaaaataacaaagtttaactttaattaatttccattttccaaaaagtgaataaactaagcacttcctgtgtgctaacaaatttaaattttgcactgactctgtgtggtaggttctattattaacataaccatttgacaggtaacataaatgatagaatggacaaatttccatatctttcccaaggtcacacagctaataacaagtcaacaacaggagttacccagacatcctggatatagctgggaaaagaagcaaggatagacaaaaagactaatggtggtggtggtagacaggtttttctaaaaatggaattttggatataaatgccaagaaatatggggtgtagtttctggatgtaaaattaaagaaatgctaacacacatacacacacacacacacacacacacacaatcatcacatgaaaaaaacagcaataatggtcatgcttacaattgtatcattacttctactccaaattcagttgtttcacatgaataatctatggcaacagtgaaactgaataatccctgataaatttttcttcttattgactcttccctttgaactggcactgttattgctacttcttaaatgtttctctaatttgttctgttcttttctcatatctccttctaccattccttaattgcttaattaattgcttttgtttggggccttgaaatagccttcccactgaaataggggactctgctcacttcagactcctctgttgctattgccattattgagtctttgtaatgccttcaaggttatctttgtccataaatctgatcctggtactctactagtcccgtgtttttaaagaacaccctctgttgtcctcagaatacaattcagtagccattgtgttgtgtaagtatcccctacttcccttcccctttaatttatcttgccctttcttcatcatatggaccctctgtcagccacacttgccagtacctcaagcatacaattctctgtcattctgatttttttgcctgctagaataatttttgtcttgtagtttactttgtaggctctgacactttttttttcaaatatgttccaacatgacatctctgaggcttggcacggtggctcacacctgtaatccaagcactttgggaggccaaggtgggcggattgcctgagcacaggaactcgaggctagcctgagcaacacagtgaaaccctgtctctactaaaatgcaaaagaacagccaggcgaggcagtgtgcacttgtggtcccagctacgcaggaggctgaggcaggagaattgcttgaacccgggaggcagaggttgcagagagccgagatcgcaccactgcactccagcctgggcgacagagcaagactccgtctcaaaataaaaataaaccaaccaaacaaaagacatttctgagatgcttttcctcatcataattaatctttctctcccctatgtttccataacactttgttcatatgatttttagcacttgcctcatattaatgatttgttaaatacaatttacttgactagactgtaggctcttcaaaggcgaggaccacaaatcttattattcttaacaaaacagaggctaaaacaattgtggtcatgctctatagcatagaaatgtgaagctacaatactttattgcttttatgtttgagcagacaaaaatgtttcaagataatattgatcattctagcagccttctatgtgggcatttttgttagtttactataactttagaaaagaatgtgatttccaacctttaagctattaaaaatttgttattgtaaaatatagccaattataacataagaatcatttacagtcaattttttaactaaattgagagaaattataattatggagcatggctttaattaagtgtgttcattctatctatcatctcttcttggaatgaggcaaaatctacccttaaattaaaacaaataatcagagttttatatatgtttatttatatcacaacatatggtactaaggcacttctaaactgagtattaagagattatcctacagtacttgttgtccttgagccaaagacagtggtcagaatctctgtattattttcatttgaaccagtgtacagtattctgagttttttatagaaaggatatttttattatgcaccatttaatttatttaggcagtgcttaacccgcacttttccttgcaaatggaactttgtgaagaaaaatttgtgtaattcattgagatacaaaacattccaaggaataggttctcttttctcttgtaaactgcccttattcaaagtggctgtgagacaaaggaggtggcatgaactggctctagagaacatgtcactgacagagacaaatgagtcttaatgagttcaggggaattctgacagctaagatttcgagctctgaggaaagaactactgcatggaggacacaattctgaatcatgccaggttcagagtaagctttgcagaaatcagcacaattgatgtgtatggtgtgtttgtttttctgaaaagctttttacttttgtagaaaacattgcacatttgtaaaatgaggaccaattagaaaagtaaaaattcttacttgttcactataactcaaaaatataatcaatccacaaaaaaaaactcataaaagcaaaatcatctaactaaaatcttagactccaagtcagttcctttctctctcctctgagtttaggcttattccagggagctgcctaataaggccggttcatggcacctgctttgtgtcaccgccactttgaataaatgtcatttccagtttctgtaactatagtgatatgatgatgcccagctcttcctttgtcaaggattctgatgactgtctcatatgtactgactagcctttccaaggtaggtgatacccctttagttaatatatgcattaatttactccaacattctgtaagaaatagaaagtgtttttattatgccaaaatcctatgtgcccactgaatggcccatagctataccatatggagggcacagcaagaattggagaaaggctctcccttcaggctaaaaaatataggaaaaaaagtgttcccataaagagcagaggctgagctggagttcagttttttctcacctctcaggaaagggctttttatgtgttttgtaaactacacaattcctagtggtgacattgtcccaagaagacaaagagacctgacaatagggtcattagtggagtgcagcagggcacagttctgtgggctcgaagccatctgctaagtgggcagtggaggggagaagagagaacaaggattggcataatgttggcacccagctttaagatgtattatctaaaagtttttgagatttataagaaaatcctgttctactgagcatagatttctcatttcagccacctattgattactacctaatatccatattgtgcactgcaagatgttgagccgggtatggtggctcatgcctgtaatcccagaactttgggaggtcaaggtgggtggatcacctgaggtcaggagtttgagaccagcctagccaacacagtgaaacacccgtctctacaaaaaatacaaaaagtagccgggcatggtggcaggcgcctatagtcccagctactcggaggctgaggcacgagaatcacttgaatcacggaggcagaggttgcaatgagccaagatcccgccattgcattccatgcattccagcctgggcaacagagtgagactgcatctcaaaaaaaaaaaaaaaaaaaaaaaaaaaaaaaaaaaaaaaaattaatacaggggtttgacagaggtttgctgtgagaccatttctgcctgaaaatttagagcaatcctaaagggctcctgaagtgtataatgtcataactattaataatatgtacaatatgtcaaagaccaattgttaagcaatggcctgataaaagtttatggaggaagataacggagacagacttatgaatgtagcttaacagcctatacgagattctaagccaaaaaaaaaataaacattaggctcatcttgtatcaatttgttaagcgaaactggttggcataagtgattttgataatagaagagctaacctgctaaccttatattttgaattcatttgctaaatagccaaggtgaattaattacaagcatatagtttcttttcagagcagagggagaaaaaaggtattaatccaaatggaacatttcttccaacctataaaattaaaaatgtgaaaaaccaatttaagaataacaacatactttaacaggcacatacattaatcacatgcccgacttgaaagctattgaaacagtaagacttggcaattctatccacccaaaataaaacatcagcattcttctcagagttacaatttatatgctgtgaaattaaatcacgcactataaaaccaaaaacaatagcaatatgcctttattttaaaaaatgcaaatcataggatctttaaataaagtaaaaaaataaatcagtgctatttagaccctcttacattgaaatataaaactagggactatcttataacacaaacataagaaatatgtttggccctaatttatataatggaagagaacgtcttaatatattatttgatgatatcttctcaaatgagaaatataatagagaagcaggctgggcatggtggctcacacctgtaatcccagcactttgggaggccaaggtgggcggatcacttgaagtcaggagttcgagaccagcatagccaacatggtgaaaccccgtctttacaaaaaatacaaaaattagctgggtgtggtggtgggtacctgtaatcccagctacttgggtggctgaggcaggagaatcgcttgaacctgggaggtggaggttgcagtgagttgagattgtgccactgccctccagcctagggaacagagccagacaccatttcaaaaaaaacacagaatgaaaggaacaaaaaagaagacaggaatataataaatataatagagaagcaaatataactcaataagtctcagtgttcattgttctgcatcaaataaatatttttaataccaaggaattttccatcatcttttcagtgataaagttaaacaatatagtctgcaatatgaaaatatacatacagattatatgcattatatacactgattatttttaatcctttctggtaatccgattccttcagactcttaagtcttcaatgtcttgtaacaagggtctcttaatgaaaaaatctctcagtttttgtctaactaaaaatttcttattcacttttaccagttaaggataatttctatggatacagaattctggttgacagtgttttggttgttgttttttagttttgctccccatccctttaactttaaagatattattatattgtttcttgtgaaaactccactttcatttgtattctcctctcactctatgtaatttcatcattttctccttcattttagatttcagcagtttgactatgatgtgtctatatatggtttggttttcttcctttgcatttattatttttggtgtttactgtatttttggatctgtaaattgatgtcttctgggaagttttcatctaattttcctttaaaacattttttctgccccaattcctctctcatcttattctagaattccaattacattatgttagaccacttgcattgtttgtgagtccatgctcattattcttccatttttttcttctctttcacatgagaaaagttccatcttcaactcaactgactttatttcctgtcaccgccaatcttcttttaaacccacacagtgttttccttttttcatttcagttactgcatttttcagcattagaattttcatttcattcttttcatggcttatatttctttgttgagattaaattctgtgtgtattcattatattcctttttcccattaagtccttgaaaatgtcacttctctaacattcttgtgtgctaatagaaacattttaattatgtcattgtcacattctatccaactgcttgttttcttgagtataggttaattttcctgtttcttcatgtagctactaatttttaattgaataataaatagtaataataaattgaaagaaaatctggattttgttataattctctgaaaatacattttatttcaagaggtggtcaatttcgctaaactagaactccaagctcagcatcccataaggttggcagcaggtaaagtcgccaatcagttattacagttgctaacagctgctttcccctgtttccctgcaattgcatgcacaatttctcaaccagcatgcataatttctaggtcagatgaagttttagggagattttgtactaaaatttgggtgttccatcccttctgaggatccctccttctcaaaggatttgcctttaaatttgtggctctttttccagttctaaggtatgccctctgacagcccaggctggtaatgctgcagctttctgttctcaagactgtaatagggtactgccttaggcataaaaaacaacatcacaaggtgcagtttctgtcttttccagtaaatcttatctctgactaacctcaactgccctcaatttttaaaaaaaatatttctttcagtttatatgatagttatctgctaaagttttaccaagtaaaatcttcattattaaatattttacattgctatttaagctattttctggaaaatcctggtacacagctgattatgcatttttttttgtttttttttaacaatacctctgtttgaaaacatttgccaaacatgttagatattgattctcctgcaaaaaggttggtgttttactgttgtttgtttcactaatttaaagcaactctaagtctttttttttttttttttttttttttttttttttgagacagagtttcgctcttttgcccaggctggagtgaagtggcgagatctcagctcactgcaaactctgcccccgggttcaagcaattcttctgcctcaacctcccgagtagctggagttacaggcacccgccaccatgcctggctaatttttgtatctaggtcttttattcactctgttaccttcctatcttcttctcttcttacttgagtatttgatctggtccttccctttttcccaatcactctttgtgctgttagccatttgactacaactatgtaaagaacctacagagaatcacctaggaaactgagaatgtcaattttaaaagatagtactgactttgtagtagactccaaggtcaatggatctttgacagaaagtaccgtcctttggctgtgatatgaaaggagaattagtattattgatttaacagtcctagtagagattatactctccttctgtgcaataacagttaaaaaaaaaaaaacaaatctgcatagttaatctgtgttaagaaaggggtgcaaaatcattattaatgccactaactgatttctaaagtattcctaattctaggtgagctttcaaaatccaaatgaaactaagaagtgatcttctaattccaattcctatcatatacaatttagaaatattaaattcatacttttagtagtaaattaagcaatgggtttaaggttggaaatagagatcctctaattgctgtgatgcaaagatctcaacttttaagtattacatttaaaataaaattaaaatatcctctctatccaatcatcataataataagaagcatgtattgtataacagctaaatagaaagtaatatctaagatggtctctacgtacattactatttattctacaattccttgaggtaaatacttgtcataattttgcttattaggaaatgcaatttcgtgaatctaaatcatttgcccaaggttacatagtaagtaagtgatggaactaggatatgatataactatatatcccatgctctttctaaatgcctgataaaaaggcttggtctgagtttatttacttcatttgcaatagtcaatgaatgtttttaaaagagctgtaagattaaaaatacccaaattgtataaagaggtcagatgatacatccaaattataaaatcaatgtacattatcgaattgacataccaatagaaaacacacacacacaaatttaaaaaaaagatttcttgtagcaagtgaagagccaaagaaaaatcatgtttattaaattgcactcaaaaacaattttaaagtattccctggtcctggagtgatttgctccaattgctagtttccaggtttcaggtactgtgaaataagattcctaagtcacatgttaattttgtaccagtgggctctctttcctttctcaatgaaacaatcgatatttttccccatccttgtcttcctaaagaaccagatttggaaagaaaaatcaactgcttaagatttaaagcgtaggttcaatactttctatttgtaacttagcagcagtcacacaaatctcaaattctactaaattgattctaagcatgaatatctgcatctgtcaaatgcggatgataatatctacttcttagacttattttatgtattaaatcatacagcttctgccacacagtatattttcataaagcttagttgctttcttttctccttccttatttccatatggtctattgttatttacaaaactttttattttaaaactttaaaatgagattatatataatagaaaatattattaaagtagaaataaaatattattaaatattttaaataaggccgggtgtggtggctcacgcctgtaatcccagcactttgggaggccgaggtgggcggatcacgaggtcaggagattgagaccatcttggctaacacggtgaaaccccgtctctactacaaaaaacacaaaaaattagcctggcgtggtggcgggcacctgtaatcccagccactcgggaggctgaggtaggagaatggcgtgaacccgggagacggagcttgcagtgagctgagatcgtgccactgcactccagcctgggtgacagagcgagactctgtctcaaaagaaaagaaagaaaacaatattttaaaaaatattattttaaatattttaataaaatatttaatattattattttaaatatataaaaataaatgtacaattccactatttgagttgaatataatcattttcatacacacatatgcacacatatacatacatacatatttttgcataattctaggcaaactaaatgtataatttttttacttgcataaacagcataaggaaatcccattgttttaaattgtgagatatatatatatatatatatatatatatatatatatatataaaatgtttatcattgtcaggataggccttagtttacttaatcaatctccaattttagggtatttttgttattttcaattttacataatgataataaatgctgtaaaaaacatctttgcaaatagtgctatttatctcttttgttgttcattcagatagaatttaaatattgaattaaagcagtatacaaattttaatgctcgagtttcaactgcttactgactttttcagagacttatgccaacaaatataactacaaaaaatgtatgagtgattttttccatgtaagtactccagctttgacagctcttatctcataatcttctgcaaaaatgaataaaaaaatactgtcttactattttactgatttttttttttttttgagagagagagagtctcactctgtcatccagactggagtgcagtggcatgatcatggttcattgcagcctcaacctccccaggctcaggtgattctcccagctcagcctcccaagtagttgggaccacaggcacacaacaccatgcctggctaatttttacatttttctgtagagacagggttttgccgtgttgcccaggctggtcttgaacttctgtactcaagggatctacctgccttggccacctaaggtgctggcattataggcaggagccaccatgcctagcagattttttacaattgaatttctataatttaccctgtgtttgttatttccatgtatttcataatatgtaaatagcacatttcctttattgtttgcatttttctaatggcattttatttacttttttctaattgagctgttcaaactctacatatcataattttaacaatctgataataatagccaatgtgttctccttgatgaaaataagtcactgtgtatttacctttaaattctagtaggcattttcaatcgcatgttcttaaaatttacaaagaaaaaaagtatgtctataacatgaggtgagagtatgtattctatttgtctttcttctatataatggaatacaactgaaatccaaagggaccgacttatcctgatgaaacacacaaaacttatttagtgctcaccacaaacttattttagccatgcagaaaaaagaaaaaaaatattaatctaagaggagaagacctaaactattgccctattacaaactgaaaaagaatttgtgggctgtactccacgtacaatggtacaaaatgtttatagaaattaatgtatagaaactaatgatggcagtgtcacgttgtatttataattttcccttaagtgctttcctaattctgaaaaaaaatgcagcaaattattgatgatcaagttgtacattatcaccagatctccagagctctgttctctagttatcctgaacatgacttgccatgcgctgcatagtgttaccctgccttcttgtacactcctagaacacctagccccgtccctgtttaaacctacctggcctcaaatctgtttaattatcccttccttaaagatgccttctatgatccttttgtacttggttaagttaaattgctgtgttctttcattgaatcttgaacttgtaaccattgcacttatcacactttatcatttattttttgtctgtcattcccagtaggaagagaattaagcaatggtttaaaacatgtaaaatactgaacagaattacaaaatctgtaacacataatgtgcatttaactttgagatcttcaaatattttcttttacaaaacttaaaaaacagaacactgtggcttactgatgtatcttttcttcttctttgggaaggggataaatagtaattaaatcctaaagataatgggtaaaagaaaaagtatagagaattcatgaaatgcaaattcaaatacagaataaaaacaaataaccacaagttaattagcttaaacataatgaataactttaaatctttcccttgatcagctgtgactttgaaacaagaaataagctactgagttgccacattataacgtaaacatatttgtggacagaaaaatataaaacactgagcaatatatgtttaaacctacattaaccataacatagattaattaattaattaatatatttttctataattccactcaagtgaaagagccagataactggaattaaaatacgaattaaatgtttagtcaaataatgttgaaaaaataacatgtcattaaattcaggttaaattcagtcaaattctttcacacatttttccttcctaaccagtcatataaaggctgaaactacacacaagcaatgtcaaaataaccaattactgtgcaataaaatatagttttattctatagtattcataatgctccaaactcatttttgcaatttcccaataagttgattaatgctttttctttgtattttggacaagggtaaatatttctgatcacatcctggtatttgactctgctgtatgtcagaattttttttctggtgcatattttttcttcttacatatctgttaacatagttttagcactatttttagccaaggaaaagaaaagttaaaaaaaaaaagattttcagattagcagttctctgggaacattgctgtgctttctaaggtgttactttgatgaatactacagtggtgacagcgagcagaccagcaaaagtgttgctgaaggacaaatgccctctaataaacatagctaagaactactacacacaacaggcgtgaaattcacccacgaggactgacttgtcctgtgtactttccagtgacaggatttctactgtttaggttaggtttgtgtttccaacagagcttagctgaaatcacagattttgataaaattgggagaagctattacactgaaatatttaacatcacttaaaagaaaatgctatagtcagtgtatgttcaagcaattggagacttgttccatatgggacagattgaagctgtttttagaatatgtttcattgaatataaacacacaatagaaagatacagaggtatgcaaccttatgcctttgtgttataattctaaagtatgacaacatttttaaccaaagccagctatgattacattttgaatagaagatggtccccaaagttgccaactgacatcttactctccctctctgagaagtaatatgcatttaattttatgttctttttatacccataaggcatggacaaacattttaagtttatatgtgtattcataatgattgttgcttcaatgaatttggtaaattaacaagaaagcatttcaaaatgaaaatgacaatcaaaactaatatgtaccaagaaccaaagatttactttcagaattaggaaaattaattacgatctatctataacatagaaggagataaaaaaaataaaaaaataaaacctccccagaaaatattgggaaaaagccattggaattttgttttcttccaaactatgatatactatgacttgctttagaaatgacatctcatctgtcattccaattctgttacaagattttatcttcttgctaggatatacaccattgaaaatataatcttataccttgaaacccataaacatttaaaaataactatataaagaaattaatgagtaaacaaataaatgaataaatttgctgtttttgcttacttccaatccagctctaaataatcctccagatgtatggcaatcaattaaaatttcctaatcctggtaagctgaatatcaaggaagtacagcttccatacaatgtgtattaaatcactgaggtaatagaaatgctggcaccatttttaaaagcctatgtaaaaatctaaacacaggaacatgtaaaagtccttctatgctcatactgcttatttcctttccagccagggcttaagttattttctgtgacatagttagagatactgcatattatgcaaatactcttgcctaaataattcttagatattatttttatttcacgaatatgatcaatatataaagcagatagagaagagtcatggtgggaaggtgagttgtaaagagattaagagaagatgggtacaaaaaaaggggcagattaaatatgtatggctacattttctgacttataatttcaacttccattattccatgattttgaaattgtttaaaacaaagggcatcaaatacttatctgcttccaagagtctggagtaccttagcattctgaggaataaaatgtattggtactatccatgtaccatagaaagaatgcctttttagaatatacttattttgctaaataaaaaataatgtatgtacagattattaaatataaagtagtacaaagttcagaatgaattagttttcattatccttaagaaataaaaacctagtaaatcacagagaaatttctagaatcttgttaaatcaataggttagttttctatgtaaagatgagtttctagaattttaggttttctacttgttcgtatttagaaaatcaccagttacctcctatttgacaaagcaaatggcatcttctgaatttttttttaattatactttaagttctagggtacatgtgcacaatgtgcaggtttgtcacatatgtatacatgtgccatgttggtgtgctgcacccgttaaattgtcatttacatttacattaggtatacctcctaatgctgtccctcccccctccccccatcccacaacaggccccagtgtgtgatattccccacctagtgtccaagtgttctcactgttcaattcccacctatgagtgagaacatgtggtgtttggttttctgtccttgcgatagtttgctcagaatgatggtttccagctcatccatgtccctacaaaggacatgaactcatcctttttcatgactgcatagtattccatggtatgtatgtgtcacattttcttaatccagtctatcactgatggacatttggactggttccaagtctttgctattgtgaatagtgccgcaataaacatatgtgtgcatgtgtctttatagtagcatgatttataatcctttgggtatataccagtaatgggatggctgggtcaaatggtatttctagttctagatccctgaggaatcgccacactgacttccacaatggttgaactagtttacagtcccaccaacagtgtaaaagtgttcctatttctccacatactctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttttgagaagtgtctgttcatatcctttgcccactttttgatggggttgtttgatttttttcttataaatttgtttaagttctttgtagattctggatattagctctttgtcagatgggtagattgtaaaaattttctcccattaggcaggttgcctgttcattctgatgttagtttcttttgctgtgcagaagctctttagtttaattagatcccatttgtcaattttggcttttgttgccattgcttttggggttttagtcatgaagtccttgcccatgcctatgtcctgaatggtattgcctaggttttcttctagggtttttatggttttaggtctaacatgtaaatctttaatccatcttgaattaatttttgtgtaaggtgtaaggaagggatccagtttcagctttctacatatggctagccagttttcccagcaccatttattaaatagggaatcttttccccatttcttgtttttgtcaggtttgtcaaagatcagaggtaccttctgaatttttaactcttcacaatatgtgggacactgttgactatcacctccttcttgagacactcttcccctttcactctgctagtaaaatatcattggacttcctactgtaatatagaccccattttctctgacacctcagatgtgttttagcttcattcagaataaatatgtatatactttaatgctccgtgtaatcttcatttaagcattacatacatactctctgcttcaatgatggtttatttacccaatttaactcattacaatgtaaatgatttgtaaatctgtatctacatttgtaacttcacctgtagcctacaatgttacattataattatttgatagacattttctcctcaagatttccagtatcttcttaaagctcaacaagtctacaaataaatgcataacaattcttcatgtccaaacctattcctcttcttttcttctgttttcttaatgtttcccacattaaatttagactccaattggcctactgatacataataaaaggaattttcctcaatactttctttgcaatttattttatatatcacttttttttcatttctacttcaaatcagcaagttttaaaaatttgccttgatgtttaaatgttgcaaatgctttataatcagcttctatatttacacttaccacagtgtaatatccaaattctggaccatttagaaattctacaatgacacctaaagtgactttccggacacagctcctaaaacttatctgtctttctttgcttcaaagaaattaagactgatgattccctaagtgatttttcatttcccatcttagttctattacttcgtttctttataatttcacttttattaattcaaataaaatttcctccataatattttacatctctgtctctctctcctttcctgtattcttgggggattttgctttattaatttataacgcacctatcctatatggcttcaatgttgtttataatagaatcataatctctcagaccagaagacaccttaaatatcgttattccaactatactatgctatttaaaatgatcttgtaacatggcagttcaattcttcagaaacaagttgttttcacgagtagaatactttacttattagaaaagtattacttatattgaaccaaaatcctctacagattttcaaatgtatgttttcagtccgcatcgtcttagtttccctctcttctatgtctctcagtcttcatttctgacttgaactatttcattaaccttttaaccggtctctatgattctctacattagtacaattttaagaatgcacattaatcatgcaaatgattttactaaaatattcttatgacaaaatctttaataggttctttattgccaactgagtaaaatctaaattgttaatcttttaatagatccttcatgatatgtctccaactatattgacagaatatacacgacacattgactatatgaaagaagtaaagaaaaggaggctaactcatacatttctggattgagcaatgaaagacaaggagctactagaataataaaacacattggaagggataatttgtgaaggtgaatttctgatttttgctctattcaatatgacttagcaatttatattaaagtagtaaagtaagtattgacagaaaatactagcggagagagtatccatttactactagcggagtatgcgtttaatactagcggagagagtctgcaagatcaaattagcagtcaccctactcatttcaggctgagctttaatgtagaatttgctgctcacctatcctcttcatatgagttattccttatctatatttaacagtttacgttctgagcccaagtgcagaacaaatatcaatgtatattaaaatgtatctcatttgatttaacaagtcattattttgtactgcaattttttaggttctgatactgtgtgtcaagccatttttttaatacatcagagatatgtgtcatctgtgaatttgataagcaaatattcaatgtcttcatgtaataaacatataaaatgctataatggataggtcagagaaaagagacattccactagaaattgcctttcagactgatattaatccttttacgcagagattatattgatatgttaatccaatatttactagtaaatacactattaatcacctattcgtatctgtcttgccacaagatgatttttcaaatcactatttgtgttctagatataatacatcatatcttttcctttggttgaccagaataaaacattatcagagatataacaggattattttaatattacatgctcaagtagtaaaatatcataagcctctactaatttcctttattcagatatttaataattgtgttttaataattaactctagaattgcctaggttttattaacaatctactgatacacatttcttatcctgccaattaacttataaacttaaaaaaaacacatactttctgtattactttacttttttttcaccaagactacaatcaatgccctaaatatagagtaagaattcaatgaatatactttatgtaaatgagttttctaagcctagatttaacacaagaaataaatgatgatcatctggattaagagatgatataagagtttcaactttgtgtgaataaagagaaaagtcaatgaacctcttatttatcaacagcccttcatgctaaaaactctcaataaattaggtactcacgggacatatctcgaaataataagagctatctatgacaaacccacagccaatatcatactgaacgggcaaaaaactggaagcattccctttgaaaactggcacaagacagggatgccctctctcaccactcctattcaacatagtgttggaagttctggccagggctatcaggcaagagaaggaaataaagggtattcaactaggaaaagaggaagtcaaattgtccctgtttgcagatgccatgattgtgtacatagaaaaccccattgtctcagctcaaaatctccttaagctgataggtaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaatctactttaaagttcatatggaaccaaaaaagagtctgcattgccatgtcaatcctaagccaaaagaacaaagctggaggcatcacgctacctgacttcaaactatactacaaggctacagtaaccaaaacagcatggtactggtaccaaaacagagatatagaccaatggaacataacagagccctcagaaataatgccacacatctacaaacatctgatctttgacaaacctgacaaaaacaagaaatggggaaaagattccctatttaataaatggtgctgggaaaactggctagccatatgtagaaagctgaaactggatcccttccatacaccttatacaaaaattaatccaagatggattaaagactcaaatgttagacctaaaaccataaaaaccctagaagaaaacctgtgcaataccattcaggacataggcatgggcaagtacttcatgtctaaaacaccaaaagtaatggcaacaaaagccaaaattgacaaatgggatctaattaaactcaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaagcaaacaaccccatcaaaaagtgggcgaaggatacgaacagacacttctcaaaagaagacatttatgcagccaacagacacatgaaaaaatgctcatcatcactggccatcagagaaatgcaaatcgaaaccacagtgagataccatctcacaccagttagaatggcgatcattaaaaagtcaggaaacaacaggtgctggagagtatgtggagaaataggaacacttttacactgttggtgggactgtaaactagttcaaccattgtggaagtcagtgtggcgattcctcagggatctagaactagaaataccatttgacccagccatcccattactggtatatacccaaaggattataaatcatgctactataaagacacatgcacacgtatgtttattgcggcactattcacaatagcaaagacttggaactaacccaaatgtccaacaatgatagactggattaagaaaatgtggcacatatacaccatggaatactatgcagccataaaaaatgatgagttcatgtcctttgtagggacatggatgacctggaaaccatcattctcagcaaactatcgcaaggacaagaaaccaaacaccacatgttctcattcataggtgggaattgaacaatgagaacacgtggacacaggaaggggaacatcacacaccggtgcctattgtggggttggggcacgggggagggatagcattaggagatatacctaatgtaaatgacgagttaatgggtgcagcataccaacatggcacatgtatacatatgtaacaaacctgcacacagtgcacatgtaccctaaaacttaaagtataatttttaaaaaaaggtaatggatgagtttttcattttaatagatgatttctaaagttttcattgtgaaacacatatatttggacttacctaaatgttagcttaaacttgaaaatgtgaccatcatcttcaaaaagcatatttaatccattgtggtagcaacaataaaaattcacaaatctcccatctgcacttgcttagaagagaagtataaaactcatttgtatattaaagttttctttaatgtagtttctaggaaaccattcataaaatcacagctgcagctaatttccatttctatggattttgcatttgttagaaatagagaaaaccgatcatactatttttgaaagccatgcacagaaagccaaattacataatcttaagcatacagatcttaataattcacaaaatgacaactcattatccctattcttaaggaaaactctgatgcatattagcattttataataatccattatatctatctacttcgctggcctaaattttgggaagtcacttcatattcagtgatacgcatgtctgattgtgagaattttctgcccaatttcctggctaggtattacaatgaagaattggtcagtaagcactaatagacagcaaactaatgacgaaaaaagtgaaaaatatattatgctcttatctattgcacatctaatgtcatatcaagcacatgaacaaatgaaaacaaaagcagacttcaataaaatctcccaacctttttttttttagttacatgtagaaatatatccaagagtttaagtttctagacaaaaatgaatgatatcccaagatactaataaaactctcaatgtcaacaaggacatgatatatttgagcaatcatggagaattagaaaatgatagaagattaaagatggataaaagttttctttattttcaaaaaagaaggtaaaatactgcctcacaaagggcattgtttattcagattataatcaatatcataatacgaaatttcattgctaaaggaaactttcatattatattctacttagcagtaatacctgtttccaacaattatctttctggtgttttatctgtacaattttgtgattgtggaggattactccgaacaactctataaaggatttataacaaaaacaatcttgaatataatgaagaaaattttccatcaattaactactgttcaattacgtataaggtataaaaactgtctggctatttttaaaactaatttaacctattatttgtaattagccaaaatggtaatagattaagatgcacaatgccattggttttataaaagaatatatccaagccacaggataaattgaaaatatatacacagtgaccattaattgtccactcttagaaatttttgccacaattttaattacacctcaggattatcttatattctttgagagaaattcatgaaggagatagtggttaacacaagcagattcatcctcaaattttgcatctgagcttgagctaagggaaaagctggtctataaataacatctttggcgaaatctgtcacatatctccagaaactgcaaaggcttcattaaatctgacttctccattaacttcagcagcagtacattccctctttaatgtacttcccatttctcaaactgtgaatttataatgaaatgattgtttacatagtataccttaaaaaacaggcagccatgaactcgcataatatggtagtcaacaaatttaacagtattttatttcaagtagactttaaagttttcctttgcagtgcagcaatataatgcaactgtggaacaaaaaacttatcatgtccacatattattttagtattatttatttagtatttccatctataagtatcatcaagagaaagtcctgaagtctgctccttcattaaacaggacagacttctatggtaaagctatcatcattgcatttgattttggactggaaatgtaacatctgaaagagctttttgcttttaaagagttaacagcttcagtaagcataattggaaaagtctagaaacatggtatatattttactcatccactcaaaaatagcatttagcttacagaagtgaaatctcaggagggtcattacaaatttttgtaagcttatcattaaaattcgtaactaagagttgtgttgaagacaagcaaattttggttcaatataaggataaatggactctacatggcataatgtatatgataaaaggaagacactgggaatacgaaatcttttaacagtagatggagacacaaataggagatcagataaaataagaataacattaatcacaatcaaagtgaagttcagaaaattgcacctcaaaatatgccattttgatatgctgattacttcaaactcagagcacctgggaaaagcacaagcatgaaggggctttccctgaactctgcttatttacctaaagaagtcacatcctctgcctcctctgaaggaaagaaatgtaattgtcctaaatcacctgcccagaaatctcatcaatcaggaaagattaactcctatcacaggaacggtgactggggtggacgtccatccagacagatgttgtcacaggctgtcacatattcttctgaggccccattcatctttctcaaaaatcatttaccgtcccctagattggctacatcctctcttgcttttcccctaagaaaagggtatatgtaagcttctagatctcactgaggctgtgagtaatcattttttggtcatatgatgcccctggacacactataaatgcgtatactgtttttcttgttactctgcctgctgtcagtttaccttatagactcaaatttatcactcagatgataaagtcttccttcccttacaaaataatataaagttgtcccttggtatccatcccccacccatagggtattggttccaacatctcccatagacaccaaaatccacagatgctcatcactgacataaaatggcatagtatttgcatataacctatgcacagttcctcataaaatatgacatagtatttgcatataacctatgtgcatctgcccatataccttaaatcatctccaggtgacttataatacctaataccacctaaatgctatgtaaagagttgttatactacatttttacttgttttttaatcctttcatgctgttttttattgattttttcaaatatttttcattctcagttgttgaaatccagaaatacaggacccatgaatgggagggccaactgtacctggaagtcacatatgccccttactctaagtatggcaaaagtgaaagattctattagtcatattctcccaccatctgttacagatctgtgtttcttacacattaaattattactaaatcccaacatccaagttagctatggaattcctggcctttcctcactacagcactggctcatttcagattttaaccttttctccttcactgatagttcattgcagagtccagataggccaaaatgaagttctaaattttgaatgagtcaataagcagttattgtttattatcactgacagataggcccattgaaataatgattaggtatcttcataaaattgtgactacccatgcattaagtactcataatgggtaattagaagtcacagacattctcaggttaggaggaaggttgaattagaaggctactaagttcccttataatccaaatattctgtttttcatgaccctgataaaatgtaatctatcaagctattattaaataaatgtattaccatcttgcccacagtatttacacttaatgaaaaaataaatgtaatccctcctaaatggaacctaaatccatttaggttcaggcttgatctgagagaaaaggcctcaacctagggttattataattgctctcttcactacagaaacaatgtctgatagatctgaaaacctggttgaaacaactaacaaaagctattccacattacttagctaggccccctacagcctaatccaacctgtggggattcaggataatacttaaggcaagcaggagaaaatcaacaaaaccagtcatatcgggcaaggagttatttaattgcccatgaataatcagtgtatgtgaaattttgctaagggcaatttgaccttaaaatgtggttatctgatctgaaaaactttctaactttcttctgtattaaagaagaaggggtgaaatacatacaggagcatctcaccccttctttgacaattaagctttctctgagattcatggaggctcagaaactatggagctcaggcataaaatgtaaataagagatttccttttaatgaaacacattttactgctgttttgatatggctgctccaaaatccccctagggcaacacacccaaagcaaaatattctaggaaattattgctagagcaatcagacaagaaataaataaggggcatccagattggaaaggaagaagtcaaattattcttatttgtagattatatgattttatatttggagaaacctaaagactccaccaaaaaactagcagaactgataatttcagtatagatgcagaatacaaaatcaacatacaaaaatcagtagcatttctatatgccaacagtgaacaatatgaaaaagaaataaaaaaagtaatcccatttacacttgctacaaataaaatacaatacttaggaacaaatttaaccaaagaagtgaaaaaatctctataatataaactataaaacactaatgaaagaaattgaagaggacaccaaaaaataaaaatatattctatggtcatggattgaaagcatcaatattattaaaatgtccacactacccaaagcaatctacagaatcaatgcaatctttaccaaaataccaatgacattcttcaaagagctagaaaaaaattctaaaatttatatgaaggcacacacatacacagagacactagccaaaactatcctgagcaaaaagaacaaaactggaggagtcatattacctgacttcaaattatactacaaagctatggtaagcaaaaacagcatggtactagcataaaagcagagacatagaaaaatacaacagaataaacatacacacagagacactagccaaaaccatcctgagcaaaaagaacaaaactggaggagtcatattacctgacttcaaattatactacaaagctatggtaagcaaaaaaagcatggtactagcataaaagcagagacatagaaaaatacaacagaataaagaaccccaaaataaatccacatgcctacagtgaactcattttcaacaaaagtgccaagacgatacactaaggaaaagacagtctcttcaataaatggtgctgggaaaattggatatccatatgccaaagaatgaaactagatccctatttctcaccatatacaaaagtcaaatcaaaatggattaaacccttaaatctaagacctcaaactataaaaccactaaaagaaaacattaaggaaactccccaggacattggactgggaaaagattttttgagtaataccccataagcacaagcaaccagagcataaatggacaaatgagatcacatcaagttaaacagcttttgaacagcaaaggaaacaatcaacaaagtaaaaaagacaacccgcaaaatgggagaatctatccttcacctgtttattaatacattaccaaggaactctagatgtcggcataaaaagtgagaacctatgataacatcccatcttttctcctactaaaattaccttgataaggccattgttctctgcctataacttgaagtccttttctaattccttcatgttattagtcatatttcaccatgactatacataaactcctttatacccttgagcttctctttatagcccaaaatctcttgaatgacattgtactactataacattcatccttacattcctagattccttcttccattttctccattcctatttaataatgtttcaagctcagaagatgcaaagatgaatgttttagtctcctcaccccaagaagcacatttgccttaattgcctcttactgctttcaaaggttcattctcaaactctctaatgcactgttcccccaaactgattctttcccttatattctttcccctctatgtttcttctcccatcaattcttattcttattgtttctcatataattctgtgtgaatagcgaacactattctcctagtgcagttccctccctgaattgccaacagaaagatggagttcatcttttggagatcctattgacacctgaaatatcacacgtttaaagcttgactaatctctcaagctttccttctacctacacatgactttggactttcataaaatttcgatttccgttctcttgtcacttcaatatcccctgataataatctgtctcacttctcttttgaaagacttacaaccttcaaatatcacaggaaaattcagtgtcatttttgtttcaaccacaattaatgcagaaatatcaaatcttcccaattcctcccaaagctctctgctgttcacatttggaatttgaaaactttttttttaattgtctttgttcttattttgctttttctttcttattctgttttcttcaatgcaatacacattgatctggaaacctaaaattctcaacggttctcgtcactgagccatgtacatttttagtgggaaacaactgcagcttttacattttcagttgtcaactgcttttgtagtgctgctgacttcttgttctacattactgggcagacaattcagaataaaaagttttatttcatcacatatttcttccaaattgcttgaaatgctttatcattgctcctaagtaaagaatacagaaataccctcattttatggtgcatggctttattgcacttggcagatactgtttttgtttttaaataaattgaggcttttgcaaccctgcatcaaccaagtctactggtcccacttttaaaacagcatgtgctccttcatggctttgtgtcactttttggtaattcttgcaatatttcaaactttttctttgttactatatctgttatagtgatctgtgatcagtgatctttgatgttactaatgtaatttctttgaggtgccatgaactgcactcatataagacagcaaacttaatagttaaatgttgtgtgtgctctgactgctgcaccaactggccattgtttcatttctctccctctgattggacctccccgttccctgagacacaacaatattgaaattaggtcaattaattactccacaatggactctaggtgtccaagtgaaaggcagagtcacatatctctcatgtgaatcaaaagctagaaatgattgagcttagtgaggaaggcatattgaaagcaaaaacagaccaaaagctgggcctcttatgccaaacactgagccaagttgtgaatgcaaaggaaaaatccttgaaggatatcaaaaactctattccagtgaacacagaattaatttaaaaaaaaaaaagagagagagagagagagaaacagtcatatttctgatatggagaaagtttgagtgttctggatagaatcaaactaaccatgatgttccctgagccaaatcctaacccagagtgaggtgctaactctctttaattctgtgaagcctgacagaggtgaggatgctgcagaagaaaagtctgacgttagcagaggttggtttgtgaggtttaaggaaagaggctgtttccataacataaaagtgtaagataaagcagcagatgttgatgtagaaactgcagcaagttatccaaaagatctagctaagataattgatgaaggtggctacactaaaaaatagattttcaatgtaaatgaaagaggcttaaattgaaatattggaaaaatatgccattttgaactttgataggtagagagaaatcaatgtctggctttaaatcttcaaaggacaggcttactctctttttaggagcttatgcaactggtgaacctaaatttaagcaaatgctcattgctcattcctaaaatcaaagggcccttaaaaattatgctcaatctactctgcctgtgctctacaagtggaatttaaaaataggcctggatgacagcacatctgtgtctatagtatttatttatttatttagatacaggatcttgctctgtcacccaggctagagtgtggtggcattatcatagcttataagatcactgcagtcatcccatcttggcctcccaagtagttaggattataggtacataccaccacatccagctatttttttttttttttttttttttttagggatgggatcttgctagattgctcaggctggtctcaaactcctggcctcaaatggtcctcccaccttggtctccaaaactcctgggattacaggtatgagccaccacacccagcctacacccagcctacagcaagcctatggtttgctgcatattttaagcccaccgttgagaccgactgttcagaaaaaaaagattccctaacacggctcactgctcactgacaatacatctagtcgcccaagagctctgatggatatgtacaaggaaattaatgctgttttcatgactgatatcaaggcatccattctgcagcccatgcttcaaagagtattttcaactttcaagtctcattatttaagaaatatatttcctaagtctatagctgccatagatagtgattcctctgctggatctgggcaaaataaattttaaaccttctggaaagaattcaccatccaagatgtcattaagaacatctgtgattcatgggatgtcaaaatatcaacattacacaagtctggaagaagtattccaactttcatggatgactgtgaggggttcaagactttagtggaggaagtaactacacatgtggtagaaatagcaagagaactagaattagaaatggagcctgaagatgtaactgaattgctgcaatatcatgatgcaacttgagagcagagagtcatttcttaagatggaatctactcatagtgaagatgctgtgaacattgttgaaatgagaacatgaagattttgaatatttcataaacttagttgcaaaagcagcagcactggcagtgtttgagaatactgacttcaattttgagagaaattccagtgtgggtaaaatgtatcaaataacattatgtgcttcagagaaatattttatgaaaaaaagtcaatcaatgtgggaaacctcattgttgtcttattttaagaaattgccacagccattccaaccttcggtaaacactgccctgataagccagttgccatcaatattgaggcggaacttagaccagcaaaaagatcaggacttgctaaaagtttaaatgatgcttagcacttttaccaataaagaattttttaattagggtaattacattgtttttagacaatattagcacatagtttatagtatagtgtacacgtaacttttttatataccaaactgatacaaattggttttatagaaaaccaaaactattgggtcacttgctttattgctatatttgctttattgcagtggtctggaaccaaacctgcaatatctccagggtatacgtatataatgtttgtatgcattcttgttatttgataatatgttaattccttagtcatatactgaaattttatgtatttttaaaaatttatatctatatagaaccagaggaaagtgattaagcaaaaagataacttccattttaacatcatttataaaaattaccacaagcctacaatttctaaacggtcatatttcatagctcatcattatgtagataattataaataggcatttcataagtagattaaccattaaatctttgttaaaaatgggacaattttgaaaatttaaaggagaccctaaatattttaaaaatatataatttttgaaatagtgatacattgaccaaaaagttggtttcattgtattaacaaaattaaaaattatcctgtccacattattttcaaaaacacaattatatttaacaaataaaaacaatgtgtttatattcataaaaaactaagtataacaaaaattatttgtatatattcacacacttaaatcaactgctctatgagtctaatgctgtttatctagtaataatctgaagacttaacacagtcatattgcttttagtatttttcatattttctttaaagattcattttctggttcgtaaatacgacactgcttaaaccttccattggcttttctctatagcgtggaagttttttaactgaggaaataaaacctctttacaaatgctaaggtatctgctaaactaatatcaaattctaaacttttcatattcaggatgtgcaattcaaacatttttgcagattctgtctttgtttctacttagagtgcctttctttaacaaattttttttaaagagaaaacatgctgaaatgtcatgccttcttaatttcatcccaatcagatttatatttttaaaaaactttacttaaatataggaaagttattcattcaaatcaagatagtccaaagcttttaagctatggtaatttaatatgtttagttgatacttaattttataggaaatctttatgttttcctctttgcacacttttttaaaaaataatttctattcattgaatcctcctgagtgtaattttttggcatattatttattgaataatttgattaaaatttccaattcatcttaaacaaatgcaatcaatttagagtacttctaataccaaaaaagttcaataccattatggcacacttaagttgacttctaaagtcattcttcaaaggctaaaatattttgtaaatcagacttttagtgggtagcaaaaagagaaaatgtgtattactaagataaaatacctaattttatatttaacattgcatagaaaagaatttgactggcctttgtccctggctcctgagaaaaaagaaaaaaaaaaaacccaggtaagacgagtctctttgttatttatgagccccttgaattacgcttgagtttatgctaaggagatatctcaggatgggggctggtcactgaaatgatcaataatgtgattagaaaattggggctttgagttagcctgacttccagggataggacagggttacagattgagttcaatcacatgtccggtgattaatcatacttacttaacaaaatcctaactctggacatggaaacttccctggatggtgaacacatcaatgtgctgtgagggtgatgcactctaattccatgaggggagggcttggaagctttgtgtttaagactttgcatttggctggtcctggtttttattctttataataaaactgtaatcataagtatagtgctctcttcagctctgtgaatcattcagtgaagtatccaactggagggcggtcatgggaaactaccacatttttagtcagttgaacagaagtacaggtggcctggtgactcccaaatttgtggctggcatttgaagtgataacagttttcttggtggccctgtccttaaacctgtggagtttgacactaactctggaaggttaacaacagaatggtatgtctgtctacacattttgtggtttcataatgctttatgtgtatacctgtcataccttcccaatttaccaaagtgtgttttcctaacatctttctcttgatatccaacagcagaatgatatcagagaaaaaaccctagaaaaatctcttgatttaaaatttaggtaaattctagctgggtgcagtggctcattcctgtaatcctaacactttggaaagctgaaacaggaggatcacttgagcccagcaatttgagaccagcttggccaacacagtgagaccccatgtctacaaaacaaacaaacaaacaaaaaacccttaggtaaattttatacacaaataggcacacacagaaagacacatatacaaacaccaatatgaagctattaatgaatatctgggtaaaaataacaggcacaaaggtaattccttgagatgaatcctgtgatttagaatattaagaatgtgagaattgtcaaagtggaagtgataaaaagactaaaaccagaattgccactttttctttctacacgtcactcagaaaaaaaattgcttaacaaatgtacgcaaaaccctcttgaatagatgatacttcatgtaaattgaatggtttcctaacaccaagactgacactttgttctcagaatggacgaataataaaaggcaacattaatttgaattaagcaaaatacataggatatgtgatggaccatttaaaactagaacttgaagaaaggacatatttagcataaacctgaattggagaattctgtactgaaacatagttttgtttgtagaaacaaattcatataaacaaattgtaaacattttgaagtttttttctgaaacagtcccttaataaacctaaggtaaatttaacatttatcatacctggatttatctttcttttttatagtgaatatatgtagtgaatttaaaatatatagtgaaggccgggtgcggtggctcacgcctgtaatcccagcactttgggaggccgaggtgggtggatcacctgaggtcaggagttcaagaccagcctggccaacatggtgaaaacccgtctccactaaaattacaaaaaaatcagccaggtgtggtggcgggtgcctgtaatcccagctactcgggagggtgaggcaggagaatcacttgaacttggaagcgggggttgcagtgagccaagatcatgccactgcactccagcctggaggacaaaagtgagactccatctcaaaaaaataaataaataaaataaaataaaaaatatatatagtggaatccctataacatttcatttatgaattgaacaatatgttgaaagtgatataagatttacaagtataagacttacaatagaattcctacactgagaggaaacagtgttaagtattctcatatcaggaaattaagataatataaattatttctgaaacaattctaacaacacttcacatcattgataaaatgttgaaaatgttaaatttattcaacctctttttagtgaatttacagcaattatttaatgaatagtcatcatatacaacactttttataaggtgccttacaaacattttgtctaattcacccaataaccctgcattttgatcatttacagctgaaaaatctgagtcccaaaaatatataagtccacttcctatttttgaagagctttcttctccaatttctatctatgtcagtttcattttgatttgatactagttcttccaactatgcccataggttagagcaacattgtagctgtgaacttacaactgaggtgacatatgacacctgagcaaaactagtagcctaattattaccatctacatcctcagacccaatcataaatgtcgtaaaattcttcttgacaaaatgtaatttgttaagtaatgaaaacttaaaacactgagttaatctcacttcattctgctccacaaaggaaatttaaatgattaatcccatcctgatacctcaaaaactttgtctcccactaagtaaaaataatgtgaacaaggaaattaaatgtgggtgaacctttaggaagcttttttttttttttgagacggagtcttgctctgtcacccaggttggagtgcagtggcgccatctcggctcactgcaagctccacctcctgtgttcacgccattctcctgcctcagcctcccgagtagctgggactaccacgcctgactaatttagtagaaacggggtttcactgtgttaaccaggatggtctcgatctcctgacctcgtgatctgcccgcctcggcctcccaaagtaggaagcttttacctacaactcctatcctcctaaaagtgtcatgcccacacagaaaagtcaatgtatgtttccatggctgttttaagggtagactattaaagcaacaattttgctctaactatgtaatcctttatgccagtctcattttataagagcaaatactcctattatcttcatttctataaagaattatattttacagacaatctgatattaacataagctttccataattgtcagtagtaaggaacatgagatgataaaaaggaataatcgcaaataaagaaggagtagctggcagcctgaattacgtctgttattaatctgtctcagaagggaagaaaagaaatgacagcagaaaaaaagcataaagggattcgttgggcacactggagctacacatttgtgtttgttaacaacttccttttttcctctgccctgtaaactcaaaatacctttataaaatagcccaaaataattatcttgtcagaagaatctttgtgtttttgtcaaattaaattaaactgaaattcatcatgggaagaagatatcagagaaaaagcaatgaaaaggtaaattaaaattgaactgtcagatttaagggctggtccaatggaaatgaccaataaactcatgagtaatgataaacagggtagatatttttcctttgatctcactaaatctacaccctattcccaaatgttcttttaagggaatgatattaaattaactatagatttttctatctgcagaaaccagtgggagcaatgaatggaggaagtgtcatcattaagctgccattattcctagtgcatagcaggctcaactcaccctgtagccttgtgtggccttaaaatcctccaacacacactaatagttttccctatagaatatatttgcatgtataatcatgcctgttccaccattaaacaatattttaatggaaaaggctgtgcccttgggtagttataacttgtaagcacaggagtcaactttattgtgatattataaaagagtggtaaaaataattaagcagtcatgcctggcacggtggcttgcacctgtaatcccagcattttgggaggctgaggaaggacaattgcttaagcccaggagtttgagaccagcctgggcaacatagagagacctcacctctacaaaaaaatcaaaaaaatagctgggtgtggtgtcacacgggaggctgaggtgggaggatggtttgttccctggaggttgaagctgcagtgacccatgatcacaccactgcacccagcaagggcaacagaatgagaccctgtctcaaaacaacaacaacaacaataataataataattaagtattctatttgttaatatcattctcatggtttagagattaacttaattgaatatgacacagttttgagagaaaattactttgaagagtatcctcattttggcaacaaaataaaattgaaatgtgttctcagagtaacttgagatggtggtataatgatttgtgtataaacaacaaaatctgaatactgctaattagtcatggttctcttaaattgagtagttctatcacaggtcaatatcattctctctccaacagatgacagaatttattttatcattctaacaatgtaattactgaatttttctcatctctcctaatctgagattctattagcactgcccagtataataccaccttaattatatgcatatttgatttccatttttaaactctataactggttgtctcttttttaggttgaggtaggtctaattaacttaatttaggaaaggtattttatttaaaataatatcactttcttgtcattactctcccacatttgtaatctaaaagtatcaaatactcatttttcattacacaatatttttattactagatagtttactatttcagtatttgagattatagtatttttcatttaggtcacaattatatttccataaattttaagttagaatattaaattttgcatcatttaatgcctcatatcaaagggcagctgcagctttatacatcaaaatccagattatcaagagagtttatatgctgggaaacacacaaagcaatgatcacaaatggaaattgatagtaatttttttcaaagagaaaataaaagaggaaagaaaaataacaataaaatgagaggaaaatggagacagactaaataaaagactcccttgactacaggtcctcatacgtaagtgaaatgatcctgcacaatggttttctggaagattagcccttctgcactctgggacgggttcctccctatgaggaaaatgcccaagcaagaactctcatatggtttcttgtgcaacgaataggagctttataaaagcagaaaactttgaacaaggacaagtcagtattaggtgagccatacacatgaagtaaaagtgtcagtctgttcccctcactattactttctctctgatacaggttataggttaagaaaatacacaggcattccttccagaggaattgagttgctgcaagtttgtccacttcaagttcatgaaatgttttataacttaatattgttgtcaatacataggggaatttcacttaattggttttaaaattatggataatatacaaaagaagtaagacaattaagatgaactaagaatggaattaagatatatcaattgaatggaaatttattcatctgccagcatcacagatttttctttcatttttttttttgtctttctacctccttttcttcttcaaaaattatttgacacctaccgtgtgccagaaattgttcttggctctgctaacacaacaataaacaaagaatgtcccttttccatgtaaaggaatggggtgactggtaggaaacaagcaactttcttacagggtgaaaatgcagtgaggaatatccataaaaaaggaaggagctgcaggagtacagagctgaaagtgaatagcactgagctgcttacagagctaaatgttgacatgcagaactaaatcttaaagattaacacaggttaactaaacccagatggtgaaaaggagagggcattttaggctacacacacacacacacacacacacacacacacacacacacacacacagagttatatacagttcaaaaacatggtggcatgaaaaacatagcttttagattgaatttcaaaaagtgccctttggaaaatattgaccaaaaatagtcctcatctaacacagtgcttgccaactaaatgagggtaaaattaagttctaactctgacccttcacttgaatggccattttaactgtccctggaaagtttttaaaacacacctggattttggattcagcctccttaacatgattcttaaaggatgtgccttttgcttgtaaaatgcataacacctctatcttactttcatatgtgaagtacacacacacacacacacacacacacacacacacatatacacacactgctatctatggtaattaaagttttcactaagaacttgctcaaaattatagtgttagtaaagacataaaacaggtattagcttcacatataacaggtctttccactctactcacgtgcagccaggatttttgttttgtttttgtattggctattttcactattttagtcatcagtaacatttgtaatcatatatttaaaaaataatattaagagtattttctctttcttgagcaaatgttacgatcatcagattaaaaaatccacaaattacccttagctcaaagttttatccttaaaaatatttaataatttgtagactctctaccttaataaggaagactgtctcattaatacaattaatcttctttagatgattcagaaaagctacaagaccttggttaaattttctgatcacatcaatttttaggaatgtaaagtgcaaaatttgaaaaaaaaagcataataaattggaatgaaatagaactggtcccagaataacgctctgtgccttagtttcttcatcatttaatgggcatactaacagtgtttaactcagttattgtgaaaattaaattatttaatatgtgtaaagtagaagatttcccagcacagagtagaatttcattaaatgttaatgactgttattattattagttttaaaaatcaatcattttttattctgttatccattaaattggtaagcaaaaaaaaattaacactcgttatattttaaagtgtgctttaaaatcttagaagtgtcatgacaatggaagaattgtttacttattcaaaccactaggttctttttttaagtagctttattttaaaattatgtacgtaagggctcggaaaacaatacatcaaaatatggtatcttggcaaactaagtattttaaactgaaggaaactgataaaatcacagaagttgaaaggtctctgatctttttccaccctttctctcctgaactaaggctcagaaaccgaaattccccttacccctttctctctgaagcaggtcataaagcctagacaggttactctctgacagtctccttcccactcccctggagatccttttatgactggtgtcctgccctacacccagagggaagaaatgtcacatacagacacaggaaataatctgaacagacagaccttgctaagttacctccagctaatgacctttagatcatatccttttgtcctccaatcatacttctacatgattgtccattaaaatatactattttccctgggtctctggttcttcatttctgtaggtttcaatgtcatatgaaactttatatgctttgtttttctcttattaatcttttcttgtgataaaggaattgtccatgaaccttgttgtagataaggaaaaattattacttttcctcctctaaatgtaatattaaaggttttacccatgtagaaagatttatattttaaaaattcttttgagaaattcagaaataagacagttacatatggctgaaagtttgtttgatatttgaaacctcaagacttctgtgagtttactctttggaactttagggtgtaacatttcaccatgtttagagttctatttaattaattaatttaatttaatctcaattactgttttggttattaatattacaaaagaaataaaaactgctcactatatagttctcaactaatacaagatttatttaatattcccagtctttatctgtttttacaaaattcaaacatccatttttttaacattcaggatataactttatatctaaagtcttaatatagtttaaagtttaaaattagtaagtacaattttaattaatctatatttttacaagtagattatgtgggcatcattattatcatcatcatcatcatcatccttatcctcatcatcatcatcctatgatttggtgccaagaatataacataacttctcatgctagtatattttaacatacaggaaatgacttagatatttaacttgatgggataacctagcttaagcacaaatcttccagacagatttgactaaaagctaccaaatgactgaagtaaaaaatttgtaggtatttgccagattatctaaaattaatgtcatgaaatgttagtgtacactgaagaattcctattgctatttttaattaccaaagctatattttctttttaattatgtcaccgtgaacatcttttatcgatatttaatttaatctgatattctctttcttccttcttctcttcctttgttcctctctcgctttctttttctatttcccctacttctaaggtatttttattgcatctttaaattctcatgtagattcttctgatgactctgcttatgtttcttttattacacatttttctagagtagatatcatctggaacatggaatctactgacacatttcttttttcaccttatcatctccatgtttattaggcaggccaattgattattaacagtcttttggcaataatcttttcaccaccatactaccttaccagctgggagagaaacttcagcaaagcaataattaagacactgataagacaagctattttgttgctttcctggtttacacagaggacgcagaatcgggagctaaatatctttaatactcaatatctaaaacattactcagatcatttgacttttatacctacattgtatccaacctaatttttaaactggatagttgatctagtctaaaaacaaaatctaaaaaagtaaacaaaacacacctaacattgttagtgccttacttttaaaaagattaaaactttcagtaatatggataagtagataaatagagtactaattccttattattaccctcattctagaattagatgtttctgacacaaatatacaaagaaatttcacatgtaaaaacctgctgcggaatttaaaattcttttgtgacaatttgctcctgtgacaagtatatttttctattctatcatgctcatatttcatactattaaaataaatacttatgaggattatggacaatattgctcacttgataatttaatacctgatatgattgtactgttgaaaaaattgtacaagggacaattcatgctgtttcccatttttgacttcttccatgtctacattggtttaattaaatatgcttagtttctaaaactctttttggttcctctagcaggcataatagattgtcccattatggtcccttcctctttccttcctaatgacatacagatgatgacttcattggtgtgtccactagtacccatgtgattcacgtaaatccagattagtaaacaaacccagtaatcccattccccctgacaattattggtgtaaaattgggtatgtagggttaagtttcatggttttttcttggagatgttttctgactcttaaaaagagaatcagagaacacgctgtttttctcttttcttttggatattttattatctggacacgcaaactggagttgctataccatattgtgacttggggcaagatagatgaaacgccaaaatagacaagctaagaatggtggggatgaaagatgtcatcaaagaacctggatgcttcatgggaattttgagttatgatattaattagctccatgcctgttctactcaggatatttactacagatttttacaaatgtctttattttaaagccaatatgaggacagacgcggtgtctcatgcctgtaatcccagcactttgggaggccagggcagatggatcacctgaagtcagtagtttgagacgagcctgactaacatggtgaaaccccgtctctactaaatacaaaaaattagccaggcatggtggcacatgcctgtaatcccacctatttgggaggctgaggcaggagaattgcctgaacctgggaggcagaggttgcagtgagctgagatcatgccattgcactccagcctgggcaacacgagtgaaattccatctcaaaaataataataaaaaatattttaaaagtcactatgagttatgaccattgatattttgtttataaatgcatttgaaagcatcccatgtcctttctctttagacattgtggtgttagatccaatcataatagagagcctgatggtttctaagcagtgatttatcttccactcttctctccattcatttgtacacattatatctattgttatcctcctttcagcctccactgtggaaattgctttgataacttattaatgccaaaggataaataaaaaatatatacccttcaagaagcattttcattctaaaggattttaaatcagaccttaaccctgaggaatgaaatatctaataaagtaaattacagaaattgcatcagactcatgagaagcacttctcattgtcctttcatgttctccttatttggtatctttatgcttagtccattacttaaccataaaacttcattctttcaggaatgctcaaagtactttaaagagaattaacctggatatagtgcaatctgctcagggctaataatattaaggattcacacacttggaaaatatctataaatgattttttaaaaagataaaaagaagtgtggctgtgtttttgtatatgtggacatacaactgttgcattttagcctggtctatagccaagattgagagtgatataatcatattacttttctaaattggggaaatatgtttcttctcttttaatggtaaaatggtcttaccatacataaaagattggtgatacagaatttcaggaactaatgattgactctgtattcattaatttgtttaacaaaattgtgagcacgtactggcaccaatttagctattgaggatacagcactgaacacaagcccttcccttaatggagggactttgtagtgttgtgaatagggaaaaagagataaaaaataagttcaatatattaaatgtcattgtgatttgtgatatggagaaaagatgcataaaatgtagaataggaagtgtgtgggtagggaggaacatttcattttttttaaggtcgtcaggaaaggatctattgaaacataacatttgagcaaacacctgcattagcatttgttttgcttagctgcgcaaaatgtttttggcatacagaaattcatgcttggaaggttgatgatagaaacttacttgttttaagaaatttctatgtacataatagaatattatctatgcatataaatgtctctattcaaatttcttcaaaggacctcagcttaaacacatttaaaattaaactcatcattttcttcgaaatctattactcttttctgctcttcttccccaaacaacttagtaagaacataggcaccactgcagttcaaaaatctgaacatcattatgaaagtcctcttctaattcaatacccaggctgactaaggtattgtctcattagggaaactgcattttctgctaccaaaatcccattgctaatagtgtctagtgcaaatacagctgtgaattcacttcatttatttattttcctgaggagggttttccaataacctccccccaccccgaaaattgttaaaaaaacactgtaacactatccttttcttacttttttgtacatttactttataaatgttgtcctttggtcagtgaaccaaaaccaacagaagaggacaaaatggtcttatgtgctattaccatgaataatgtcttccagaaatagacttgaaaattgctcccctaatgccatcccattcactatatacttaaaaaaaatctatgagggttgaaaatattgagatgattgatttaagatacctattattactgactgctgacatttggccttgggaaattacattcgcagtagtatttttaaaatgattaagagaggtttctgaaaaaaagtatttacattataagatgtatttttagaatttgtttcttaaaaaccattatataagctttctgaacaaaaaaagatatttattttatgagaaaaatacactgaatttgcccttataaattataatttgtaaaaattaataaatgtaagataagtagattcccaatagcatatacaaaataaaacttgcttacaactgatcataaaatgtaatgtgcccattgaatatggtaaaagggaagtatatgaatcataaaattttatttttcctatcctatccacaataccatgatgctatatagctattaaatttggaacagttttcaggaatatcttggtttattgggcttaatgatattgtgcttctcagataaagtaatttttacaaatttaagatttttgcaactctgcatcaaccaagtctattggtgccatttttacaatagtatgtgctcacatgacactttcaggtgtcacattttggtaatattcataatatttcaaactttttcattattattatatctgttatggtgatctgtgatcagtgatctttgatgtttctaatgtaactgctttggggtgccatgaaccatgccatgtaagatgacaaacttcatcaataagtgtgtgttctgactgctccctcagtcagctcagctgtttctccatctctctcccttccttaaggactccttattccctgagacacaacaatattgtaattagtccaattaatgactccacaatggcctctaagtgttcaagtgaaagagtcacacatctctcacgttaaatcaaaagttagaaatgattgagcttagtgacaaaggcatgttgaaggccaaaacagaccaaaatctacgtttcttatgccaaacagttagccaagttgtgaatgcaaaggaaaagttcttgaaggaaattaaaaaggctacttcagtgaacacaggagtgataagaaagagaaacagccttgctgttgatgtggagaaagtttgagtggtctggatagaagatcaaatcacccacagcattccctaagccaagtcctaatccagaccaaggcagttactccgttcaattcagtgaaggctgagagaaatgaggaagctacagaagaaaagtttgcagccagcagagtttggttcttaagatctaaggaaagaagtaatgtccagaacagaaaagtgcaaggtgatgcagcaactggtaaggtagaagcttcagcaagttattcaggtatagctaagataattcatgaaggtgaacgaaggtggctacactaaacaacatattttcaatgtagaccaaacatccttctattggaggaaaatgccatctaggaatttaatagctaaagatgaaaaatcaatgcctgtttaaatcttcaaagaacagtctgactctctttttaggagctaatgtagctggtgactttaagttgaagccaatgttcattgactatcctgaaaattctaaggtccttattctcagcaaactatcgcaaggacaaaaaaccaaacaccacatgttctcactcataattgggaactgaacaatgaaacacatggacacaggaaggggaacatcacacaccagggactgttgtggtgggggcggggagggatagcattaggagatgtacctaatgctaaatgacgagttaatgggtgcagcacaccaacatggcacatgtatgcatatgtaacaaacctgcacgttgcgcacatgtaccctaaaacttaaagtataataaaaaaaaggaaataagctcaatctactctgcctgtgctctataaataaaataacaaagcttggatgtcagcacatttgtttacaacatagtttaccaaatactttaagcccactcttgagacctactgctcagaaaaaaagatttctttcaaaatatcactgctcattgacaatgcaccaagtcactcacataagagctctgatgaagatgtacaaggagattaatttaatgctgttttcatgactgctaacacagcatccattctgcagcccatgcttcaaagagtattttcaactttcaagtgttatgatttaagaaatatatttttatatatttatgaagtatagctgccatagatggtgattcctctgataaatctgggcaaaataaattgtaaacctaggattcaccatcctagatgtcattaagaacactgttgattgatgggaggaggtcaaaatataaacattaaaagaaatttggaagaagttgattctaaccaccatggatgaccttgccggattcaagaattcaatggaagaagtaactgcagatgtgttggaaataataaaagaactagaattagaagtggcgcctcaagaagtgactacattgctgcaatctcatgacaaaagttgaatgaatgagaagttgcttatagataagtgaagtggtttcttgagatggaatctacacctgataaagatgctatgaatattgttgaactggcaacaaaagatttggactattacataaacttatttaatgaagcagaagcagaggcagtgtttaagaagactgacttcatttagaagttctaccatgtgtaaaatgccatgaaatagcatcataagctacagatacatttttctgaaggaagagtaaattgatgtggccaacttccttgttgtcctattctaacaaattgccacagtcaccccaacttacagcaaccacccttctggtcagacagcagtcatcaacatcaaagcaagacctcccaccagcaaaaagtatcactagttgaaggctcagatgatcttgttagcatactttagcaataaagcattttttaattaaagtatgtatattttgtagagatactgctattgcacacttaacagactacagtatagtgtaaacataacatttatatgcactgataaaccaaaatatttgcgtgactctctttatggtgatattaactttattctggtgttctggaaccaaaccagcagtattttggagataggcctttttgaaccaattcatcccaatttctccatcagcccacctttcaaatttgtgaatcatcctgaacctaatcttttattttccccttccccaggaggtatgctaaggcttttaaccctctatgcaaacttaaagcattctttttataaatgtttttgatgtctctgtaccaaatgaatgacctacattcaccaagtttatattctctacctgaatgtatatctttattttggaagggttggagttagctatttgctaacaattactctcactacaaaggcatttaatcaataaatattattaacctgctagtacaatcagaatattgttggagctgaataaaattattcttgttttcaaggttattacaatttaataggtggaaaaaacacatggaaataatattaatagcatcatgaattacatatgcatcaattgctagaaattagaacaagacgaaaatcttctgattagaatgatccagaaagcttaatagagggctgacatcagtgctgggtgttggtggtagggtatgattttaatatgtcaaaatggggaattagctgtgctatgtcatattgtatttgtctaaatgtacataaaactagtttcacaaattatcatgtattcaatttgaaaagcatcttgtaacttaaaacatattttcataggaatgtaagaaatataaaattataggcctagcataaatttgtgattatttatgtattaaatagttcccaattttacaaaacatttggcctccagtccttaaataataatccattgcaggataaatatatcattaaaaaatctaggtagcataaagttctagttattttaacaactatataaagaaatatatgcaaattataaaatgagctttataagaacttttctgacattataaaacttatcacatgaagtagcttttcttatacttgaggttttatttccttaaatgtacttagaaatacgaagcaatgcatctgttctttgaactgaatttgaagaaaaaaattaagaaaatgatattgttgcctaagttgatattaatattagtaattttcaaaatcgcattaaccagagagtagggtggttggaagtagtgtcactattcttttgtatgccatctgtaattcatggtttttgaacacatgcttagaactcacagtagtgatgagacttacaaacctagcttactatgattgatgacagcagagttaagcaaaattaaacaactgagaggaaggatatttttgtcacagggatggtaagaaaaggtttagttgttgccattgctaatgtttactctagttctctttttagatgacccaccacagtgtcctgagaagccaaaatgggataattggggtctaatggaaggccaacttagtaagacaaaggtctatctaaagggtctcaaatgagggtattagggatgtcaacaccaggctggaaacatattccaagcagtgattaggcggtctcttcttggaagtgaatatgaactggcattagattcaggcttgacagtgaaatatgtggagccttctgactcaacatgcagcacatattgtttattttctgttgctatggagaaaaaaaaaatgcacctagtcaactcctctccagtgtgttcaaaactatatgccagtgtttccaggaagcattagataagagtgggaggtggtgaggcaaacatctacagtgtcacactgtctttaagccaattttagagattgcatgactcctgaatcatcatagctcaacagtacggagcattcactttgtcagtgctatattctaagtgctttacatttactaacccacttagttctcataacactttataaaataaataatattaatattcccattttacagatgaaaaaaaatgaaggcatagagcaattaacaaacagccgaagttacacagttaaaatgtaatatgactaaaattcaaatcaggcacttttgctctagaaagaagagcaaagggaagtaatatatttttagtattctcagacttgaggaaatatatgcaaaaataatataataaattaaaagcaatacctgttatatgtctactatactggctttcactcacctggatgggattaatcagtatctacaattaattttgtgcaaatgtcatcgttatctcatgacattttcaaatttcctaaaacaacctctcatatcaaaagtaatgtttttaaaccaaactttattatttgtattaacatataagtatctgtttataaaatcaagtataataattaaatatacacagaactattgaataaagaacaaatgtaaggcacgaagctacagatttttaaacttaaatcctaaaaatttagtcaaattctcaaagtttacaaatgacaaacggaaaggtaatcttattggtagtcagataaactcttaatagctgactcagatcagtattgtttcctttataccaagctgtaggtacaaagtcttatttttcctacagtcatcatcaagttccagattgtaaactgcctcataaattgaacctcaccaacacagctcaagaccaatctccatgccttgtctcttgagacacacagtaaatgaacctcttctccttttccctttggtcatattttcgtctcctgcaagtatctaccatggtctcgcaaagatcctaatacttaaaaaacaaagagtgaaattatcaaggagagaatatagtagtagtgagagcttacaaaaattaaaaagagccaaacaaaaaagtgaataagtgctgatttataattgggtttttaattgttaacatttcaatctaaggtttagatattagatacagaaatatttatacattttcatagtttggaggaagggaaggtatagcacatcaagctgaataataaattaaaagtaataagtaatctctgaaatacacatctatataaaaagagagaaaaagaaaagatgatggtctttgtcttttgtttctgttttttaagcagtgcaacaatggaatagattatgtgagaatttctcttcctggtaaaagactgatttataggagatgataaacctctaaatgttgacatgttaactcctttcggatggtcaaagtgtcaaaatatgcctgccatttagatgcaatatccttccaccacattcctctggaatattaattgaaagatatatactggagtcgcctattcaaagccacagtcccgctgagaccttcaaggattcagcctattcagaaggctgaatatattgccctgaaaggttcctatgtcctactccctggacctaggaaaatattagattacatggcaaaaggaaattaaggttgtggaggtaattacggttgaaaatcaacaggccttaaaatagggagattaccttggattgtccataagggcccattgtagtcacaaaggaccttaaatgtgaacaaggaaggcagaagaggagaatcagaagagctgtgactagaattaaatcagagtgattcaaagtgaggagaatttaaatttctcctgggggtcacaagccaaggaatgtggtggcctctagtacctggaaaaggcaatgaaacaactcccccactgcagattacagaaaaaaatgcagcctacctacatcttgatttaactcagtgagaaccatatcagacttctgatctacagagctataagatttgttgtttttttgttttgttttgtttattatacttttaagttttagggtacatgtgcacaacctgcaggtttgttacatgtgtatacatgtgccatgtaggtgtgctgcacccattaactcgtcatttaatattaggtatatctcataatgctatttctctcccctccgcccaccccacaacaggccctggtgtgttatgttcctcttcctgtggccatgtgttctcattgttcaattcccacctatgagtgagaacatgcggtgtttggttttttgtcctcgcgatagtttgctgagaatgatggcttccagcttcatccatgtccctacaaaggacatgaactcatcctttttatggctgcatagtattccatggtgtgtatgtgccacattttcttaatccagtctatcattgttggacatttgagttggttccaagtctttgctattgtgaatagtgccacagtgaacatacgtgtgcatgtgtctttatagcagcatgttttataaccctttgggtatctacccagtaatgggatggctgggtcaaatggtatttctagttctagatccttgagcaatcgccacactgacttccacaatggttgaactagtttacagtcccaccaacagtgtaaaagtgttcctatttctccacatcatctccagcacctgttgtttcctgactttttaatgattgccattctaactggtgtgagatggtatctcattgtggttttgatttgcatttctctgatgaccagtgatgatgagcatttgttcatgtgtctttcggctgagaagtgtctgtttgtatccttcacccactttttgatggggttgtttgtttttttcttgtaaatttctttgagttctttgtagattctggatattagccctttgtcagatgagtagattgtaaaatttttctcccattctgtaggttgcctgttcactctgatggcagtttcttttgctgtgcagaagctctttagtttaattagatcccatttgtcaattttggctttggttgctattgcttttggtgttttaaacatgaagtccttgcccatgcctatgtcctgaatggtattgcctaggttttcttctagggtttttatggtattaggtctaacatttaagtctttaatccatcttgaattaatttttgtataaggtgtaaggaagggatccagttacagctttctgcatatgactatccagttttcccagcaccatttattaaatagggaatcctttccccattgcttgtttttgtcaagtttgtcaaagatcagatagttgtagatatgcagtgttatttctgagggctctgttctgttccattggtctatatttctgctttggtaccagcaccatgctgttttcgttactgtagccttgtagtacagtttgaagtcaggtagtgtgatgcctccagctttgttcatttggcttaggattgacttggcaatgcgggctcttttttggttccatatgaactttaaagtaggtttttccaattctgtgaagaaagtcattggtagcttgctggggatggcattgaatctataaattaccttgggcagtatggccattttcacggtattgattcttcctacccatgagcatggaatgttcttccatttgtttgtatcctcttttatttccttgagcagtggtttgtagttctccttgaagaggtccttcactcccttataagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcctatcaccttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtggcagttttcaaagggaatacttccagtttttgcccatttagtatgatattggctgtgggtttgtcatagatagctcttattattttgagatacgtcccatcaatacctaatttattgagagtttttagcatgaagggttgttgaatttgtcaaaggccttttctgcatctattgagataatcgtgtggtttttgtctttggttctgtttatatactggattacatttattgatttgtgtatgttgaaccagctttgcatcccagggatgaagcccacttgattatggtggataagctttttgatgtgctgttggattcagtttgccagtattttattgaggattttggcttcgatgttcatcaaggatattggtctaaaattctcttttttttttttgttgtgtctctgccagggtttggtatcaggatgatgttggcctcataaaatgagttagggaggattccctctttgtctattgattggaatagtttcagaaggaatggtaccagctcctccttgtacctctggtagaatttggctgtgaatccatctggtcctggactttatttggttggtaagctattaattattgcctgaatttcagagcctgtttttggtctattcagagattcaacttcttactggtttagtcttgggagggtgtacgtgtcgaggaatttatccatttcttctagattttctagtttatttgcatagaggtgtttatagtattctctgatggtagtttgtatttctgtgggatcagcggtgacatcccctttatcattttttattgcatctatttgattcttctctcttttcttctttattagtcttgctagcagtccatcagttttgttgatcttttcaaaaaaccagcttctggattgattgagtttttgaagggttttttgtgtctctattttcttcagttctgctatgatcttagttatttattgccttctactagcttttgaacgtgcttgctcttgcttctctagttcttttaattgtgatgttagggtgtcaattttggatctttcctgctttctcttgtgggcatttagtgctataaatttccctctacacactgctctgaatgtgtcccagagattctggtgtgttgtgtctttgttctcgttggtttcaaagaacatctttatttctgacttcatttcattatgtacccagcagtcattcaggaacaggttgttcagtttccatgtagttggcagttttgagtgagtttcttaatcctgagttctagtttgattgcaaaatctgtggtctgagaaacagtttgttataatttctgttcttttacatttgttgaggagtgctttacttccaactatgtggtcaattttggaataggtgtggtgtggtgctaaaaagaatgtatattctgttgatttggggtggagagttctgtagatgtctattaggtccgcttgctgcagagctgagttcaattcctggatatccttgttaactttctgtctcgttgatctgtttaatgttgacagtggggtgttaaagtctcccattattattgtgtgggagtctaagtctctttgtgggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcacagactaggattgcaacccctgcctttttttgttttccattggcttggtagatcttcctccatccttttattttgagcctacaagtttctctgcacgtgagatgggtttcctgaatacagcacactgatgggtcttgactctttatccaatttgccagtctgtgtcttttaattggagcgtttagcccatttacatttaaggttaatattgttatgtgtgaatttgatcctgtcattataatgttagctggttattttgctccttagttgatgcagtttcttcctagcctcgatggtctttacaatttggcatgtttttgcagtggctgatactggttgttcctttccatgtttagtgcttccttctggagctcttttagggcaggcctggtggtgacaaaatctctcagcatttgcttgtctgtaaaggattttatttctccttcacttatgaagcttagtttggctggatatgaaattctgggttgaaaattcttttctttaagaagtttgaatattggcccccactctcttctggcttatagagtttctgccaagagatcagctgttagtctgatgggcttccctttgtgggtaacccgacatttctctctggctgcccttaacatttttccttcatttcaactttggtgaatccgacaattatgtgtcttggagttgctcttctcgagcagtatcactggggcattctctgtgtttcctgaatttgaatgttggcctgccttgctatgttgcggaagttctcctgataatatcctgcagagtgttttccaacttggttgcattctccccgtcactttcaggtacaccaatcagatgtagatttggccttttcacatagtcccatatttcttggaggctttgttcatttctttttattcttttttctctaaacttctcttctcacttcatttcattcatttgatcttccatcactgatactctttcttccagttcatcaaatcggctactgaggcttgtgcattggtcatgtagttctcgtgccatggttttcagctccatcaggtcctttaaggacttctctgcattgattattctagttagccattcgtctaattttttttcaaggtttttaacttctttgccaagggttcgaacttcctcctttagctcagagtagtttgatcgtctgaagccttctctcaacttatcaaagtcattctccgtccagctttgttctgttgctggtgaggagctgcgttcctttggaggaggagaggcactctgatttttagagtttctagcttttctgctctgttttttccccatcttcatggttttatctacctgtggtctttcatgatggtgatgtacagatggggttttggtgtggatgtcctttctatttgttagttttccttctaacagtcgggaccctcagctgcaggtctgctggagtttgctggaggtccactccagaccctgtttgcctgggtatcagcagtggaggctgcagaacagcggatattggtgaacagcaaatgttgctgcctgatcgttcctctggaagttttgtctcagaggagtacccagccgtgtgaggtgtcagtctgcccctactggtgggtgcctcccagttaggctactcgggggtcagggacccacttgaggaggcaggctgtctgttctcagatcttcagctgcatgctgggagaaccactactctcttcgaagctgtcagacagggacatttaagtctgcagaggtttctgctgcctttttttggctatgctctgcccccagaggtggagtctacagaggcaggcaggcttccttgagccgcagctgggctccacccagttcgagcttcctggccactttgtttacctactcaagcctcggcaatggcgggcacccatcccccaacctcgctgccgccttgcagtttgatctcagactgctgtgctaacagtgagtgaggctctgtggtgtaggaccctctgagccaagcacgggataaaatctcctggtgtgccatttgctaagaccattggaaaagcacagtattagggtggaagtgacctgattttccaggtgccatctgttacccctttctgtgactaggaaagggaattccctgaccccttgcgcttcccgggtgaggcgatgcctcaccctacttcaggtcacactcggtgcactgcacccactgtcctgcacccactgtctgacactccccagtaagatgaacccggtacctcagttggaaatgcagaaatcactcatcttctgtgtcgctcaggctgggagctgtagagtgcagctgttcctatttggccatcttggctcctccctcctattgttgttttaagccaccaaatttgtggcaatctgttgcagcagcaatagaaaatgaatatacaagcctagaatcatcatttagtctcttagagccattatttagtctcttagcaccagagactaaattaataaatattcgtgattccccaagtttatgtggttttgctgtatgtaatagactatcttaataaaccttttgaaatactcctatgttttaaaaatcaattccagagtcaaaaaatatgcacctcaattctgtgggccatcactaaccaaggttggctataatcattccattatatctttaagactacataaccaagttattttcaaacctgtcagatcaatgcttctaaaaaagtcaggaaacaacaggtgctggagaggatgtggagaacaaggaacacttttacactgttggtgggaccgtaaactagttcaaccactgtggaagacagtgtggcaattcctcaaggatctagaactagaaataccatttgatccagccatcccattactgggtatatacccaaaggattataaatcatgctgccataaagacacatgcacacatatgtttattgtggcactgttcacaacagcaaagacttggaaccaacccaaatgcccatcaatgattgattggattaagaaaatgtggaacatatacaccatggaatactatgcagccacaaaaaaggatgagttcttgtcctttgtagggacatggatgaagctggaaaccatcattctcagcaaactatcgcaaggacaaaaaaccaaacactgcatgttctcactcacaggtgggaattgaacaatgagatcacttggacacaggaagaggaacatcacacactggggcctcttgtggggtagggggaggggggagggatagcattaggagatatacctaatgtaaatgacgagtgaatgggtgcagcacaccaacatggcacatgtatacatatgtaacaaacctgcacgttgtgtacatgtaccctagaacttaaagtataataaaaaaagaaagaaatattaacaccatgtttattaattaaaattaaagacccagaacatatgtcattaactgaatacttgtgcctactaaatttcatacattgaaatttaatccccagtgaaacagaatttggaggtgggacctttaggatgtaattagttcatgaggtttgagctttcccaagtaggattaatgcccttattaatgaggtcacagagagctctctttctccttctctttcttttatatgagaatgcagataaaagatggcagtctacaacccagaaaagggccctcatcagaacctgaccatgagggcaccctgatctcagacatcaaatcttcagaattgtgagagatacatttctgtcgtttatgtgccaccaaagtaccagcattacttttctttataccaagttgttacagtatcttgaactaagacaatataaaacctacctatacacataaattcaaaaaatatataatcccctatagataagataaatagcagggaagtcaagataatataataatgtacatttatattccggcaagactacactagaagacacaatgaattaataagtttgtccccataggtagaatcacagtgagtacttcagactgaaacagttatgttgcattggccactcgaatactgagaatggagtggatattgtgtaatttcgaacaacacttgtttaaattccaaacaaaatgttatagaatctcatcatttgtgcagcaattcctttacttcaaaatgctgtgtatgccaaatcctaggtaatctttacttgtgcagcactgcctaagttgcaggatagctagaattcctgaccccctcctctaaatgccgacaccctactcacctcctgccccaccaggcattatgataattttaaaagacccagaaatccctttacaaactctttatcttttaactactactaactcattcttcaagttaggagtcaccccctccaggaggacttcaccgactactcaccaggctagatgaggcctttcatacctgtcagcacccagaaacctctgcttttctctattactgctaacagtaacgaataagaatgtcatataagcaatgatgaacattaccctgaaagtttaccacttgctgggcatgctgagctctcctgtgaattatctcatttatctcacgcctgataaaaatagtttggttataacagttagacaaggcagtagcttgaaagacagtttatgtgcagaaagaagagattatgattttgttttgttttattttattttaaggtagaggaaatcaagcttgtgtgtatgtaaagacaagacaacagtggttctgagagagagctttatgttacagaaatgagaataaattcccagaaaagataaaagagagagggtaaccttaaaccaaaagaagattccctctctagtgtaacagcagcaattggagatagactgtaagaatcagcctcagaagctgttttcagcataatacactgtgtgagtaggtgtgattgaaagagaaggagcaatgggtgtcagtaaaagagaatatgattaaaaaatcagttgtggggtttgcagcagtagggaagaaataatgtgatataggggctagaaaactggctgtaaaaggaggattccaggtttgaagtcttacatagagaaaaagatcaggtttagtgagtcaagtttagagttgtatgagatggctgaagccattagtgcaggtgtagcttttgggatgacaagtaaaggtcatagcccatgtgtggagaattgactctgttaaggtctttgttatgaaagaggtacaggaaattagggcttttgcatgttggttgattatgaacaaaattatgaccaatgatcataaatagaatgaataggagatggcagaacacaaattttaaactccaaaagagtaaagtttgccttgtcctatatgtgctttctagagagttctataattccatgtgaatggcaatacatgtttttaatggccaatagtaatatttcaatagatgctagcatttcatttaataatttttatttatctgatggtcacaggaatcaataattagaagagaacattgcttaatagttaattaagttcctttaataatgtgacagttagacaagttgtctaaaggtgacatctccctgatctataaattttcaggctcatgggaacattgggcacatcttttgatacactgcagcttccttatccttgacactacctagtctatttagaaaatgtcaatcagtcatcaaggcaagatatcaattggatgactatgataattactccacttatacatatttttcctttcaattttcaggtatagatgcaaaaatttattgtactggtgtattttttcagactctacaattctaaatctcagggtagtgtctgtagtttcagttatattctaaatgaattgtttatttaatgctagttaatttccaaccacttttatcacatctctggttaaaagttcattccataaaatacattagctaaatttcctttcatattaggtagaataatacatcaggaaaacagtccaaaaatgtttcatagaatttttaaagactaatttaggttcatagcaatattgagcagaaaatacagagatttcccatctacccactgccctcacacacacatagcttcctccaacatcaacatcctatgctgcagtggaatgtttgtgaggttatcaattgtttatttcatagattgtggctttggtatagttacagttgatgaatctacattgacactttgttattacccaaagtccatggtttacattaggggtcactcttgtaccttctatgggtttggacaagtgtataatgacccctttagtattatacagagtagtttcctgccctaataatcatctaggctctgcctattcatccctccctcccacaaacctgtggaaaccactgatctttttactgtctccatagtttcacctttccagaatgtcatatagttggaatcacaaggtatgtagccttttcagattggcttctttcactaagtaatatgcatttactcttcctccatacatattcatggctcgatagctagttacattgtattggttggtttgtttgtttttcacagataaggtcttgctctgtcacccaggctggagtgcagtggcacaatcatagctcactgcagccccaaacgcctgggctcaaacaatcctcccacctcagtctctcgagcaactgggactacaggcatgtgccaccatgactggctaattttttttttttttaattagtagagatggggctagcttcaagcaatcctcccaccttggcctctgaaagcactgagattgcaggcatgattcactgtgtttggcctagtttctttttagtgctgaataatatttcattgtctggatcaatcagtttatttatccattcacctactgaaggacattctatttccttctaagttttggcagttatgaatatagctgttataaacatttgtgtgcagatttttgcactaatgtaagtttttaattcttttgggtaaataccaagggataggattgctggatcctttggtaagaatgtttagttttttaaggaactacttgttgtcttccaaagtggctgtgccattttgcattcctaccagcaatgaatgagagttcctgttgctctgcatcctcttcagtatctgatgttgtcagtgttctagatttttagtcattctcatagatgtatagtggtatctcactgctgttttagtttgcatttccctgaggacttatgacatgaagcatctttttcatatgcttatttgctctctgtacatctttttggtgaagtgtttgttaaggtctttggcccatttttaaaatcagattaaagcaaagacattcttattgttgagtactttgtacattattcttgatatattttggataacaggcctctatcagatgtatcttttgatgcatttctttcagtctctggcttgtcttctcattctcttattctcttgacattgtctttcacagagcagaagttttaaattttaatgaagcccaggttatcaattgtttatttcatagactgtgcctttggtgtggcatctaaagagtatcactgaatccaagattatctaggttttctcctatgttttcttctaggagttttatagttttgtattttacatttagctccgtgatccactttgagttaattttcatgaagagtgtaaaatctgtgtctagatagattatttttttttttgccacatggatgtccatttgttccagcaccatttgttgaaaagattatttttttctccattgtgttacctatactccattgtcaaaaattacttgactctatgtaggtctatttctgggctctgtattctaccagattgatctatttctctcttctttggccactaccatactatattaattattttagctttatagtaagttttgaagtcaggtagtgttagtcctctaatcaattgttttaagtattggaaatcttaaagtatgcggagttcataatgaaaataaaccaagaataaaggaatctttaagtgtatgtgtaaatgattaaagatatttggagaatgagactaaccatggaacactaatagggagctcattatttgattggcttttgatattagcataatattttatttttcatgggaactatattagagaaagaaaacaaataatagatgatactaattagctattgattttcaattaatctatgtattatcatatttatacatttctaggccttttctgaatcttatttcattatatcatatgttctaaatgaaaaatattaggtttgcttaagaatctttcttttccttgaatgaatttgtttcttggactgtttttgagctccttgaactgcaatcagtacttatgaacttatgtaaagaaatgttgttagttttaacatcactgtacgaatccaaaccatcaattatttgaatagtttagagggatatgtatttacataaacatattcacagaataaggccttataaaccaccctaggtaatgtcttttttaacataggtacaagaaccaaaccattgaagatttagaagcaatgaaaagttatcttattgtttgcctagataacttcacttaggaaatgtgagaaaatactggttacttcatttttaaaaataacatgaaccacgttgttttcattttggaaattttatgaaaatacaatagccagtaatgtgcccaaatatttttattttaaaatattgtttaataaaatatctacttgtttatttttccaaaaggataactaatttggaaattacaaatcccttcctctctaaatcatttgggtcaccaaacaaaaatgtttttcctatattctgtacataccttttcttattttcagaataatgactttgttagtccttacagttgcacgcgcgcatgcacgcacgcgcacacacacacacacacacacagacacacacaaacacgcacactagcagagaaatccagagacaaaggtagaggtatattctctctctctctctctctctctctctctccctctctctctctctctctcacacacacacacacacacacacacacacaccccacatgtaagatgcaggacacagtgtgctacatttatattaggaaactacaaattgtaacctcttatccctgatggtaggccatatttagcaagacagtgaagctggtaaatttctataacacctgggcagagttccaatgggaatatccacatgtttaagagacagacaaggaacctcatttaaccttgttactgccaatatgaacaagcagagaagcaaaaacaatgtgttctggacttttaaatggctacagcggggtagctattttcattattattattattattattattgaattttatttatttatttatttaaagacagagtcttgctcttttgcccaggctggagtgcagtggcacaatctcagctcactgcaacttccacctccccggttcaagcaattctcctgcctcagtctcctgagtagctggaattacaggtgcatgccaccacatctggctattgttttgtatttttagtagagatagagtttcaccatgttggtcaggctagtcccaaactcctgacttcaaatgatccacctgcttcagcctcccaaagtgctgggattacaggcatcagccaccatgcccagtctattcctgaattttaaatttagagtactgctgttcttctctgggcctaggtcagacactttgagagctacattaagacttgcagacctcttaagggacccttaaaagcctttcagtggcaatttactaaatggtttcccttagcggaatgaaagtttcatgtctccccaagtgcctcagcctctcagggctcagagggaaaaaagtgttctttctgtttgatgatgatagtaccattattttccattgctttttcagatgccaatattacatcaaggtatcatgatgtaatgattctactttcatttcagataaattagtgcctctagtatcctctctctgagatgaaggaagaggtaatagtcttgctgaatcaatcacagataatagaaatgctagtgaaattacccactgaggctttcccaacctctctactgaatgaaaagagccctgaaaagcagtccttgctcaaaatgttcaaaatgttaccacacttttctggatcctagctttctcaaatgaaaagtaaaatcattgaactgaatgactgctatggaaaattctaaccaaagcattccctgatttttaggttattgaatatcacagtcagcaatgtcacgagggaaagggaatcttccagattatcacaaataaaaaaattcattaaaaatagatacatttttcattcttagattttctatttctcaaaaccacaattctagtacaatatccagatttttaccataattgcataaggagatgtctccttaagtaacccacatctgacattaaccaaattcatcactttcttcatccctaagtaacctccccctactaccttctgttatttagattatggtgacagtacagaagttctatcagtgtaggtataaagaatgaaattaattagtcatgacaaggaaagttacttggaaattctggcctgtggagtgtttgagttaaaacatctaagagtaatctgaaattggagctcagggcagatgtggtggtgaaatacttgtgggaacctctgtcatggaaagttatggatgtggaatgactttatccaggaaaagaaagacaaatggtaaaacaggtaatatagcaaaaaggcaggatatttttttccaagtaatagagaacaatagaaattgaaatgcagatatatacagtgtataaacttctaaaagctaaaagcctgaagccctctaacatctaagctgtcaagaccagtcatgcacaagaagaaattcaatcctcagggctgtgtttcccagctgggttacctcacttggattctggccaagttggtagctctgaagacaatcaaaatatatgcaaattaagaatttgatgctcaaacaccctgtttatttatttaaagacagagccttgctctgttgcccaggctgaagtgtagtggcacaatctcagctcactgcaacttccacctcctgggttcaagcaattctcctgcctcagcctcctgagtagctggaattacaggtgcatgccaccacatcaggctatattgaagctgtggagcttcaattgttttgtctcattttgctaaaatatgttttatttcttggtgattccatatttaaatttcagtaagtcattctatagtctaaagatatatttaaggtataatttagttaaatgaatagagactttgaaatcctgtggtccagcatactatgctggctcttccccttaaggagctatatgactttataatttttatttgactctatatgaaacaattaaaaaaaaaccaaacaaccaaatgtcattctgtgtctcagtatcttgtggatgatatagctattccctgaattatgatggttcaacatatgactttttttttttactttataacgagtttatcagagtgttaactgtactttggacctatgatttttttttttatttgacggagtctcgctctgtcacccaggctggagtgcagtggcacgatctaggctcactgaaaactcctcctcctgggttcacgacattctcccgcccccgcctcagcctcccgagtagctgggactacaggggaccacaaccacacccggctaatttttttttgtatttttagtagagacagggtttcaccatgttagctaggatggtctctatctcctgaccttgtgatccacccgccttggcctcccaaagtgctgggattacaggcatgagccaccacgcccagcccggacttatgatatttttgacttgcaataggtttatcaggacataacctaactgtaagttgagaagcttctgtaatggtatttgcctcattgagattattgaggcaattaaaaaaggcagtgcatgaacagggacttgcacatagtagataattaaaaaaatagttattctaaattgctctatcacagtaaatacacatagtgacaatgactttcacaaagactgaaatctataatttatttaatctgacttcccattcaagagaaattcagctgatcaaataggaatgtcaatgaataacagtttgtgtacataatcatgcacagggagaaaggcatgaaacacacaggggcaagcagcaaaactccagctgttattgtattggaacagggaattagaacatggattgtctaggtgaagctataatttctccctgtcaaattgccacttagttagagtttttaaactaggatccctaggtgaggttgaagttgtccatgaatcatgaaattatgtgcaaagttctgtgttaagctatgcacattttgtcatggcaaacagtccataatttacatcagaattacatactaaaggaacagttgctgactgaataaactaaattagaatagctctagaacttttgtattatccaaaataaaattagaagaatatcttaagtgaaaaggcaaggaactagagaaagaataggtgtttaatatttccctcaaaataaacagtacatttatctgcttcattatttgtttaccttaaaagataacgttacctcttacaaagaggagctgctaccattccttctgaaactattccactcagtagaaaaagagggaatactccctaactcatttaatgaggccagcatcatcctgataccaaagcctagcagagacacaacaaaaaaagagaattttttagaccaatatccctgatcaacattgatgcaaaaatcctcaataaaatactggcaaacagaatcctgcagcacatcaaaaagcttatccaccacgatcaagtcaacttcatccctgggatgcaaagctggttcaacttacgcaaatcaataaacgtaatccatcacgtaaacagatccaaagacaaaaaacacatgattatctcaatagatgcagaaaaggcctttgacaaaattcaacagcccttcatgctaaaaactctcaataaactaggtattgatagaacatatctcaaattaataagagctatttatgacaaacccacagccaatatcatactaaatgggcaaaaactgaaagcattccctttgaaaactggcacaagacaaggatgccctctctcaccactcctgttcaacacagtgttggaagttctggccagggcaatcaggcaagagaaggaaagaaaggggattcaattaggaaaacaggaagtcaaattgtccctgtttgcagatgacatgaccgtatatttagaaaactccgtcatctcagcccaaaacctccttaggctgataagcaacttcagcgaagtctcaggacacaaaatcagtgtgcaaaaacacaagcattactatacagcaataacagacagacagccaaatcatgagtgaacacccattcacaactgctacaaagagaataaaatacctaggaatctaacttacaagggctgtgaaggacctcttcaaggagaactacaaaccactgctcaacaaaataaaagaggacacaaacaaatggaagaacattccatgctcatggataggcagaatcaacatcgtgaaaatggccatactgcccaagataatttctagattcaatgccatccccatcaagctaccaatgactttgttcacagaattggaaaaaaactactttaaagctcatatggaaccaaaaaagagcctgcattgccaagacaatcctaagaaaaaagaacaaagctggaggcatgacgatacccgacttcaaactatactacaaggctacagcaaccaaaacaacatggtactggtaccaaaatagatatatagaccaatggaacacaacagaggcctcagaaataagaccacgcatctacaatcatctgatcttcaacaaacctgagaaaaacaagcaatggggaaaggattccctatttaataaatggtgctgggaaaactggctagccatatgtagaaagctgaaactggaccccttccttacaccttatataaaaattaattcaagatggattaaagacttaaatgttagacctaaaaccataaaaaacccttaaagaaaacctaggtagtaccattcaggacatacgcatgggcaaagacttcattactaaaacaccaaaagcaatggcgacaaaagccaaaatagacaaatgggatctaattaaactgaagagcttctgcacggcaaaagagattaccatcacagtgaacaggcaacctacagaatggaagaaaatttttgcaatctgcctgtctgacaaagtgctaatatccagaatctacaaagaactcaaacaaatttacaagaaaaaaccaaccccaccaaaaagtgggcaaaagatatgaacagacacttctcaaaagaagacatttatgtagccaacagacacctgaacaaatgctcatcatcactggtcatcagagaaatgcaaatcaaaaccacaatgagataccatctcacactagttagaatggcgatcattaaaaagtcaggaaacaacagatgctggagaggatgtggagaaataggaatgcttttacactgttggtgggagtataaattagttcaaccattgtggagcacagtgtggcggttcctcaaggatctagaactagaaataccatttgacccggtgatccctttattgggtacatacccaaaggattataaatcactataaagacacatgcacatgtatgtttattgcgggactattcacaatagcaaagacttggaaccaacacaaatagccatcaatgctagactggagtaagaaaatgtggcatgtgtacaccatggaatactatgcagccataaaaaaggatgagttgatgtcctttgcagggacatggatgaagctggaaaccatcattctcagcaaactatcacaaggatggaaagccaaacaccacatgttctcactcatgggtgggaattgaacaataagaacacttggacacatggcggggaacatcacacagcaaggcatgtcagggggtgggggctgggggagggatagcattaggagaaatacctaatgaaaatgacgagttgatgggtgcagcaaacccatgtaacaaacctgcacattgtgcacatgtaccctagaacttaaagtataatttaaaaagataaagtcacctctttcagataaaaactgctgaggctaccacttaaaaaaacaaaagataatcactgtaagtttgggctttaaaacagttaaaagttctgtcagtatctgatacttcttagttagaaaaataatagtcgagttgctttttactattgttgtgaaaaaaagttgtgtgatatttagactcgtgatgtttgccatggataagtggctgtgttatcaattaagttgtctctgcaggatgaccacacattgcacactagagtagcattttctgttttttttttccatctttttttatcctatgctatttcactgaaataaatgtgaaactgaattcactgcagttcttaacatggaagtttcttctttctcatcaagaccacacagagacaacaagcttagaaggaaaagtaaaacattaccatttgcctaggcctgttcataactcagcacctattggtttcagcaggctaaagactaaaagcactatcaagctagcaaggaaaaatcactgtaatgtgtttagatgtgtggtcttgtcattttttcctgacttgctctataaaagtaattatagttttaggcataatctcccaattttaggcttgcttccattctctctctctctctcttacacacacacacgcacacacacatgcactttatctctcaataacctcatcaaaacagcaacaaggcagaaagagacaggtgagttctgagtaaaatatttgattaattgaccccaaaatatttttcctactttctctctttttaccagaaatcatatataccctggatcaaaatatgttaatcactcatattctcttaaaatcctaatatgttcccagtatttaataatggaaacattgtagagtcattggaattttcatatgtgataaaatttttagttgctgtaagaacttcagaacctgtgaaaatattcttttgcatgtaaaattatactaccagtatactagccattagtagatccctccaaaaattctcaggccagctcatccgcaaggagagatcttaacaacatctcacttcaaagctatcacactggaaacagttggaggagacaaaaatgcacttcactggcaattcctgatctgagaaatggccaattcatagagatgttgaacaaacccctttctgtcatgaggtctgtgaccaatttaagaaaaaggcatacatacacaagatgaatgtcaaataagtattccagccagtgactgttattggggactcctaacttctatatgggttagagaagttaggaagcacttcctgcaaaaatagtatttaaacatggttttgcagaaaggctaaactttaaatagcaaaaactgttgtctgtgaagaaaaacagtcagaagttgggtgggaagaatccaaaaagtgaagctcaatcactttacttctctcctataggattgaaatataaaggatatgggagattgagtaaaagtttggaagaatatatattttttttcctatttatgttttctagtctctagccaactatcagaaaaagctgaaaatggaaaatgcttctgcaaattagaggacaggtgaagactcaaattgggtagtccaccttggagagtaggtgggcacatctggattttgttgtgtgtctatgtcatttgacttgtcttaatgagtaggtgtttcttttatggtttggaacaaaaaaaatctaatgaagtgttttgtcacacagtaatttcaacatccttttccaataatgaatagattctactgaggctcagatgctagaagacaatcccaaatcatcagcaagcagcccatgtgaaagctccggttatacaactaggaaggaaagttttactgtggattctgccattgacctttggggcctgtgtttctcacctgtaaaatcagaagctaggagatgacagctaaaatctaggaaatcaaatcataatttttgttacaaacatgtataaactttaaataaatcagattggagtaagggcctaagatgtgttcctgtgaggaaagcacatgatcttttgtacacggactttttgatatttgttttggctgcccagagtcctttagaaacgctgtctgagctccagttattcatgattagttgtattcaggcattctaactactgcactatttttgtttgtttaaaagggctaaagaaagcatttatacgttctgacaatgcatctatattttccaaatattaagtgagaaagaatggaaagtgtgcccttatgggctggattgtgtcctcccaaaattcatatgttgaagtcctaatctcctaatatggttgggctgtatccccacccaaatctcatcttgaattttagctcccataatccccagtgttgtgggagagaccaggtggagataattgaatcatgggggtggtttcccccaagcctgttcttgtgatagtgtgttagatctcacaagatctgatggttttataaggggcttcccgcttcactgggcattcattctctctcttgccaccctgtgaagaggtgccttctgccgtgattgtaagtttcctgagtcctcccaagccatgcaaaactatgagcaattaaaccaccttcctttataacttacccagtctcaggtatttcttcctagcggcatgagaatggactaatgcttccccagtacatcagaatgtacctgtatgtggagataaggtctttgaagaagtaactaaattaaaatgaaattgttaccataggccctaatccaatatgaccagtatacttataagaagaggtcatttggacacacaaagagacgtcatggatgtgcacacagaggaaagaccatgtgaggacacagcgagaaggcttccataagccaagggaagaggcttcaaaagagacaaaactggccgacatctttatcttgaacttttagcctccaaaacagtgagaatataaattcctgtcgtttaagacactcagtctgtggtattttcttgtagcctagtaaactaatacatgtgcctttctcatcttccatttatctaaaatagttgagaatattgctgcttcttattgggtacttctatgattgctgaccaagaaaaagtgacagaatgtgtctttatttttcctgtgattaagatagaacacttatttataactttgcaatccactcttcagattcaagtgcttgagaggcaccttctccaagtgtttgttaaaactccagcgaatacacatgtacacagttttgatatagtggcaaaaaatttaggttcttttgtgatcagatttcacttctattcttaataatcagtgaaagtagacgtgtgcttaagctcattatttctagtgatcagaagcaatctgaacccacataatatcaacaaaagtaaactaatccaatcaaatatctgtccaattccacagggaaaaacagttacagtggttatacagtaaagtatgaaattttaaaaacatggttgaatatctttcaactaattatttcttatagttcgatataagtggcatattgttccctacttttcatccctttaggagtttaggaaggcaggaaaacacaacctataatattgtaggtgataacccaagtgtaccctgttataatatctgatgcagtctgaatccatttgctgttttagtattgccaagcataccttttccaaccaattttcttccattctcagacatcccttcaagtatatactttaagatatatatggatcgtagatgttctaatggctagaacaattgccagtatgtttccatcacttctctgaataaatcacattaaaaagtcataaaatgctgctatctagtgataaatagaagcaagacaatttgcctgcagtgtttgttaaaagattatgtaatctggcatctaatttttacagatgaatattggatgaaagtggatgatggcatatcttgcagggagcttttttaatttaatatttattttatgctctttctacagaatatttaaaatggactctaaacatagcattgaatggttgaatttgttatagggaaaatcagatacaaggcttcctgtatccaattcatagctgcaattcttgcctacaaaatctttactgccagaaaaaccattaaaacagtaatcaattgtggagtgtcatgcccaacagaatagcataacacaaaatgaaactttgccagttattgaaaacatgccccaatatagatttttaaaatatgactaattgtatgataaaatttccatattagttactgtttgaagctacaatgttaagcattcttagagaaacagaatggctcctggttttccttttgatcagtatgacaaaatacggtgtttattattgaataggtttatttccattttcaaaaatagcttttgaatagcttcttcacattcaaagaaaagtagatcatgagtagataatataacacaaaaacttagccaatcaaaccttacaagaaatgagccctaaaatgatgtttcacaaaattattcaaatgaattcaaaactcaagtggaagtgatttttgaaatatactttccagacagaattgacagaatgacaagtagaaataacccagctgccaataattttctaagtggtcagaccaaacacttccttgatctttacaacaactctgtgagatagataagacttttgtttttgttttatagatgtggctacccagagaagataagcaaattaccagtgtctaaagtgataccgccagcaagtggcagtgccaagattacagcaaaagcagtctgcagtctgggtggcgcttacacactcttaatgattctgcttgtaatgccattattcaactttccagttaggaacatgaaagaaagtctgtgcttttgacacactaaaaaggtcttactaataaataatggtattgttagaaattagggagccagccatacaggtgacaaagcgtctatgaactactgttctgtggtctgctgataaatgattattcaaaatgtattaataatacagggagataaattacatgtcataggctcacagaagctaaatatatcaacctttttaaaaaaatgattcacttgagctaatgaatgctttagctgtaagaactggcaacaaaatgtaaatagacaactttctcagataagacatgtacagataattgaaagagcagtaacaacaaaattaaagacacaactttaaaatatgataaaataggtacaaaatgactttcatacttaattcacaaatgtaagcaaagaggaatatggctttatagttataaagttacccaaagaccgcatctaaacagtgatttactttagttaaaatttatcagataatactattttgctggtggggagcaggcagagtaataagaggagttacccacatctcagcaaatatgcaaatctttattttgctttgctatattttcaggtatattacctgctattaacattgcagattttatacactgaaggcttattaaaagccattgaaaatgaagtataaagtcttcctgtttgagcatataacctaaatcaaacaggcaataaaagcaagccaaatatttgattactagtatatttttgagaccagtgtttgaagtgtgtagatgcttaaaattaaatgggtacctttatttgtgaatctaacctactatctaacaacttaatatgtaattttaatcatatctcttcaaaattaaaaacattcatgtctttaactctagaattgtttttctagaacttattctccaaaaagaattgtaaaattaattagttatgcaggagaataattttgtagcattgtttctaatagcaatgaattagagtcaatctaaatgccaataagttaaataatcatttattatgttgtgtagaaacacaataaatttctgcaccattacttaaaatattaaggtagttctcagactaatggtaagatgtccataatatattcttaactgaagaaaactagtgtcagagtaatgtggacagcattatcaaaattaaaaaaaaattgtgcagattttataaagtttttgtacattgtacatgagtacatagccaaagagactggaagaatgtagataaatcaattaacagttgttatctggtgaatgaaactattggagtcagtcctcatctgaatgaggactttcatttttctcttagcataattatatttacaattttaaagagtagatgtatcactctggtaatattgtttaaaaatgattacaaattaaagaaaattaactcacctgtgaagattaaaaaataagtttgaaaagacattttgtgagagaaattaatacatctaaagaaagagctaaattaacatttctgacttgtgtgtgaataatgaaacttataagcaaaattaaaattcaaaggtaagcatacttgatgggaaatattagcttcacatcctttaattttttaacacaaactttcacctcaaactttgtcaaatattccccaggcagggttggaaatgttaagtcagccaactctttcagtttatggttccaccatcaagaacaccatgactcttatactacttaagcaaccattgccagaaaatttctctcacttttataccttaaaacattttcctttgcattaaacctagtgaaaaatagaaaaagaacaaacgatttttgttttagacagtataacaaagtgagtgtatacagaaactccacctggtacagaacagattgtgtgtggggtaggggtgcatatatatgtatatcatgtctaagctgatgtaaaacaaaaaaagaaaaaataattaaaaataggaaaaaaagagaatatgatttcacaatggtaaacttaggggctggcatttatcctgaggaaatatgctaagctctaggggcttagaatatttttgaaaggagtatttatccttagtgaaaaagctggagttgggggaagcacagggctttcaagcaggtggaaagttggatcaaagaaccctcaatatctcaaagtacaggacaaaagtcacaactccagcacataaaccggattaaaacccatcccacaaaagcacaccatctatctaggcctggctttggaaagaaagactcaatcccgaaaggtaaaaaaatgaaaataaataaacaaacaaacaaataaaccccactaaagtacaataagttttaagagctctcataatagaaataacaaaacagtcatcacgaatgaatctaaatatgcatgtaaagttaaggaggataaactaaatattcagataatagatttaaaactaaggaatgataaaaatgctatatatgaaacttctataatgtattaaagtggtatgtagagaaagacaatctttaaggctcacattagaaaaaatatgagaaattaataaactaagcatctgatttgagatgttagaaaaggaacagaagagtaagttcaaagaaagttaaaaaaatatgattaggagtaggtattaaaattaccatatgaaataagccatgaacactgttatgccttcaaatttgaaacttaggtaaagacatattttggaaaataatatacatcattaaacatgactaaagtagaaataacacgatttaaataacaatttgaaaactgaattattaaaaaattttcaaaaatatcaaatgaaaaatgggacattatcaaggaagaaaggcatttaatttaaaaataccttttttaagagaatagaacaagaagggtagtctattttatgtggttcttatagtcttgattccaaaaccagaagaggtcattttgataaaagaaatctcaaatttttgcaaatatactaaaaataatagcacaccaaaatggttaataaaagaagcataagacatcaagaccaagttggatttattccaggaatgtaaaatacaagtttgtctcaacactagaaatttccttatttaattagtttaagacattttagattaaaactaaatgatattgggatatagacaaatagatcacaatatcattatatatatatatatatctatagatagatccagatatatctagatatatctagagagagagagtcatcttgataaatacagaaagggtattcaatacaaacagctgatggatggtgaaagctcttagaaaactaagaatagaatcagggaaatgcaacttactgcctttaataaaaattattggcaaaagcaacagggataatattgatgggataatatttaaagcattgtctttaaaatgagaaacaagaaagaatacctgctgtcaccttctctactcaacattatacctgagatcctagcctgtgcaacagacattaaaataaataataatactggtcataaagaaacaaaactctaattagccacagatctgattatatataatgggagcccaaaagaatataaaaacacattattagaattaataagggaatttagtaatgttgctggatttaaaaccaattaacaaaaatcaactgcatttctacatacaagcaacaaatatttagaagtgaaagttaaaataagatactatttaaaataagaacttcagtattaaatattttggaatatatctaacaaaatgtgcaaactgtatttagaaaattgtaaaattttattcaaaaatgataataagtaatacctaaatcaatagaacacataccatgttcataactaagaaaattcaatattgtaaagacatcaatttttccctaatgtatcaataaattcattacaattttaatcaaagttccaaatgggtaggatgggtgtatgtgtgtgtgtgtgtgtgtgtgtgtgtgtgtgtgtatgtgtgatgtctgtgtgaactgatgaagaactacttctttatatggtgatgaaaatagctaacatagttctaaatgagaggaattgagcaggaaaatttgccttcttagctttaaatgcttaatataaggctacagtaattaagttagtttggtgttagcacacttacaaagatcagtggaagaaaagataaagtcataaaattaagatatgcatttaagaaatgtttacacagtatatgaaaatcaattttgatggaaaatgacataacccatcatgaaaggtatattttaaattaaaaattcttcaaaatctttatgattcagggtagaaaatacatttttaaaagcacatattaataatggaaaatattaataaactgactactatcaaattaaaaacttcagtatatcaaaagacaaaattaaataagtacaaagaaaaaagtacaaatgcaagctgcaaactagttgaagatatttccaaactgtataaatgtgtcttataagtgactcctatgaatcagtagaagaaaaaaatggcaaaagacatttaagaaatttaaatgactcacaacctgaaaacatgctttaccttctttgtaatcagggaaatgcaaattcaaaccaaaacctgatactatttcaagtcagagtggcaaaaatgaaaagaagacagtattatgtgtttgagaggacatgaggcaacagtaactctctctcctctgctgatgggagaatactgtatcgatttcttggaaagcaatttggcatcattttgtaaagctgaaactgcccatatcttgtaacttgcaattctactcttaggtatactccctagagaaaaatcttagaaatgtacacaagaagacatgtaaaataaagtttgcacaacaacgacagcaaaatctggggtaatataaatgcccatcaacaataagatagataatttaacaattacagctctgttgtaaaataaaatatttcaataaaaacaaacagcaactctccaactgttgcattttttccctttgtcatgctggattatggggaatattaatgctcaaaatactgtcgatatggttgctgtctcacaatagtaggataaattgaacaatgtgtataagtctctgggcatatcttaatattctctattagattctatagtaattttgaccataaaaccttaaaaagaatccaactataatagctacaacatcatttctaccttgactggtgtgaatgtattatataaaccatgatggagtctctgtgccatactatatattcacgccaagaaatgcacaggtaaatgaggcagcccttgccctccaagatttttcagtttaaaggtgaagacagacttgtaaacaaaatttaaggaagttatcacagtgttataacatgcaggagaagcaaagaggaagaaccaactaaccctgcctgaggggatgagtgaaatttcacaggaggtgtgaccaacctgatgaaatggcatggctcttttgaggaatgttgagtaattgtgtgaagctgatataaaagaccttggcattagatgtcagcaaaaattgatgccaggataaattgaggtcagatcaagaagcgtcttgtgtatgatgctaataggtcatgattgcatcccgcagaagatagtaactcatgaacacagtttaaataaggaactgagaggataaggtttgtgttatagaagagcttagcagtaatatagagggtatacttaaaagaggtgtgatttttatatataaatgtcctttccagaatttaatccctctttaacttgaacccttttttctgtggattatatattctagcagaaaatagccatgagaatgtaagaaacattcaacaaaggacattgaagtaaatacctccctatagaactatctgtgaaaatataaagtcatatgtctgcataacaataaatacaactgtggatacagaaagaatagagtctaaaatcgaaaaataaaacttcatgctgaaattaatactgttgtctgaaatgaagactgaaagtatttcagttttatatatttcaagaatatacatttatatattgcgatatgtgtgtacatttatatctttataaaatatagaatatcatatataatctctatatattttaaatacattgaaatataaagtatatatgtatatatgattaatatatatattcaaatgccagacatcttatggtgaaatatttttcttaattattagatttaatgatataatttttattacttaagatattaatctgtacttttgtatcccataattagcttaacagcttagtggagaacgaagaaaatactagatggataaagaaaacttaaaatattctttaaattgcacacttactatgttttgtaatagtcaaattacttctgcataaataaaaggcatgtccataaaacaattactatgaaatttagaatagttggaaaattccttaagactctttttatctagaacaatctaaaagagaagtatgtctgttcaaaaactctggctttattttggatttgtttaataataataaaaaacaacttgtaaaagacaattaagaaattcaatgaatattttgaattgtgacctatgtttgtccactgaaatttaagtcctactattaaattcttttctttttttttttttgacagagactcactctgtcaccaaggctgcagagcactggcatgatcttgggtcactgcagcctcaacctcccgggttcaagacatcctcctgactcagccccccaagtagctgggacaacagggacgcatcaccacacctgcctaactttttgtattttttgtagagatgagatttttcttttttttttatctttttcttttttttttttttttttttgagacggagtctagctctgttgtccaggctggagtgcagtgacacaatcttggctcattgcaatctccacctcccgggttcaagcaattcttctgcctcatcctcctgagtagctgggattacaggcgcccaccaccatgtttggctaatgtttgtattttttgtggagacagagatttgctatgttgctcaggctggtcttgaactcctgagctcaagtgacttgctcgcttcagtctcccaaagttctgggattacatgcatgagccacggtgcctggcccctaccattacattcttaataacataataaatatttattagttttatcacaacctgacatttaaataagagccatgaagtcttataatgcatatattgtaccactacagtagcatgctatagagaagatattcaaatatgattctttcttttaaaaattcagttaactgttttgtaggctaggaagactatctttgctaaaattattctattttagcataaaacatgcaacaacttggacagtcaattttaagaaaattatcatggaaaaagtaactacattggagacaaatcttaatatagagcagagaattttaacctttgggagaagttacacctctttgggaagctgaaaaaaaaatatagatctgaagtgcatcttataaatatgtatgttgcccaaaaacacaaatatttacaaacaagttttcagagtttatgaaatatttgaatcctattccaagtttaaaacctttgacatacagagtaacaaacccatcacactcacaagggtgataactgatctcccagtagtcaatatgttatttctgcagtcttgatttaattttctggagtttctatgttatttctggagtcttgatttaattttctcaattctacttacccaagaagtgtttctattttcaagtactagatcaagtcctaattcctccagaaaatcatctttgattttaagtgtcttccaaactttaatggcaattattatctgtatcattcatttatctttcaacctataaaaattattctaagtttccgacttcataggcactaagtctcttggaggcaaggtttgtgtattacaacaatttccatttccagtgcctagcataaaggaaagcacatttataatgacagccaacacatactgattaatattgaaatcattttattattttaaaaggtaactacatacttttttatgcaatcccaaatattatgaagtgataccattaaatattggtttcctgaggcccaagtgttcgtaatttggattccattgacttgtatcagatcatgttattttgtttccttatacttcttttggtttgtatgcatttactcaaccttcctgctacactgatgaaccctgaaagtgaagagtacatgtctcaaagccaaaggataccagctgatgtcactgaaaagtatagtagccattcttctttattatagatcactttgccccattctgttttcaaaaagctaaatggaaatgacctcacaaggagaggtacttagctctcccaattattgtattccagagaaacaaagtgtgtgttccagagaaacaaagggaaactaaatatcggaagatgcatatttatattttaagctatcctcaactggcagctatccctatgatgattttcaaatagttaattatttacaatacaaacgttggaggaaggaattcttttttttattattatactttaagttttagggtacatgtgcacattgtgcaggttagttacatatgtatacatgtgccatgctggtgcactgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggtattttgttcttgtgatagtttactgagaatgatgttttccaatttcatccatgtccctacaaaggacatgaactcatcattttttatggctgcatagtattccatggtgtatatgtgccacatcagagaaatgcaaatcaaaaccacaatgagataccatctcacaccacttagaatggcaatcattaaaaagtctggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggaaggaattctttaatgtaattttatttttattaaaaattcttcagtaaaattagaaaaaaaaacttgccatatcaatagtcatcaccaaattagtatgttttatactctgtggtagaaatagtctcaattatgattcagggtattgcagataatccgcagtcttatgagcactccaaattcaagtgtagggagaaatggttactgtaataaaataagtccagtaatcatttttaaaacatagctatttagccttaggtttattcttgttatgtatagcaggtccggaaaaatgatgtaccaatggctccccaaatactgtttttcctgtatggctaaggcagttagtaacaatggacatctgttgttcatgtgatactcatccatgacaatcaagaatcctttagtaacccagactgctattttccaaaagttcctccctcaatatcttatcttgcggatcagaagtctatattttcatttgtatcctggaagatgatgaattcccccatttattaattcctgttatacataactatttatccgtctgtctcctaatttcctaggaaaacataaatccgtcatattaatgaaatcagtgataaacttcagttaaaaagtagaaatacacttgtaatatccatgtctgaatacaaactagagttctctgtattttgtaatgctggtggcaggtcatgatattcattcacaaaagctgccaaaggagacacaaaaagaaagcgaaaacttgaaataggtcacttcttcacgttgacaatggttgtggtttaaagttacctcaggcttttttgctattgataaatctttcaaatatattcatctctcacttatttagggactgattatccaatttgtgaactatccctgtggcttctcctcttttctctaatgatttctcctctgcctatttccttaaatcgttttaatactaaatgagctgcatgaaaacagaaaagaagctaaagcagcaaaatttgatacatataaacagtactgcaaaagaatttcatttgtgctcatatgtttttgaattttcaattttctgttaccccacttccatatttcacactccagattatgtcaccccacccaactcccaataatttgaaattcaaatttggaaattcatctattggttcatttagttggaaactgcatattcacaggtggagagtggaatatatttcaaaaccacagagaaaaaaaaaaaaacgtaattcaacttcgttaatttgtttttaattttccaaagctggaaattgtctctatatctcaattgatgagtttctgagctaaaaacaaaacaaaacaaaacaaaacatcatttcctgtaaccagatttcactgctttcattctaagcaagatgatataaataacaatgagtagtcaagtatttattcacataaaacaatcacatttacattaattgtttaacagaaatctttgcaaattaagcactctgacctgataattctaggcatctcaatatagtgaatcatgatcttttgggaatagagagtgagagaaaaagtgacctcagagaagtaaagtataaacattcattttacgcagatggctataggttttgctctggacatttaatatcttattccaaatataaaccaaagccagaaacaatactgggatatgttttatgcctcaattgcagaaaggcttattgaaaacacactgaaacttcatagagatgctagtgtgggtacagaatgtagtgtttaattgcaagactacagaataaaacagttgattgaaagcattctcagtggatcattctagcctcttctcacaattctcgcctgaagccccttgataaaatttgttataagcttaaggaataaagctatattaatgattttctgaatatatctaatttaaaaagtacagctgtttctcaaaatcatgaaactaactttaaagccaaatacacgtggtttgaggttaattactattttcaattatctatgtcttggctcttctctgatcagaagaaagatgaaggaagagtattatggcctgatctcatttccgtcctcaagaaattctgattacaaacgaatcttctatggtgatgacttgcaaaatagcttgaaatgcaacagttattcaactcaaaacaccaaaattatttttccaaaatgacttcagcaaatcatgaactaaaataaaagaacgtctataaagacatttttaaaagcactatgctaaataattttacatacccaggaagtatgcaaatgaaaatgactaaaagaggtatttggtatataacaatgtttttcttgaaaaaaaaaaaaaagatggcattttttttcctccaaaggcttttatggccaagtattggaagactggcagttcatacacattttacatttaacaggaaagaataaactgggaataacttctcagataaatcttcacaatgcaatgccaaactgtgggcataacgtgataatacatggagcacttataatctatgagatcacccaactttcaggaaacgaataatggaaaagtagaaaaacttatcagatgctcaatttgaagtttgagaaaagttaagggtattttaagggctgagagtgcgcctaaaatagtaaaaaattaaaataacaacaatagtcacaaggacaataaacactaatatcatgtactgatttggctcctgtatgttaagaactataattaaatagtttattctatttaatcttctatgagtaagatattattatttttactttacagaaaataagattttctcagcgtttaaagaacactttcaaagtgatatattcagtaatgttggaagttggccacaaaatttaagtcttttgcattgataaaaccataatctttgttttacattacattgaagatccaggaaaagaagaaagagaagttaatgaaaaaatatcctttggctcttccattaaataaaaaacaaacttggttgattgaaatatatgtgtgatacatccaaataggaaaagaaaataggaaaaatagctccatttttccttcgattttttaatcaaaataaagtaactatattaccataaacatacaaccatgcttccaaacacaatcaaaaacctagaaatgttgcttactctacttatcccgcaaatgtgtcctaaatacctcagcatttattgtagtcttaaagatgcctgtgacaaaggcaagtctgtggaaatgttgttatcatttataatggcaaacttttagtaggagctagaggtgggagcagtgatttcaaaaatacttggcaagccctaaatcaaattttgaaaaacagaaaaacatatatatttatacttactaacggctgccatataagttaagagaacacaagctataaagtcagaccaaaccagctttcaattgcttgcacatgttttatagaaatgttagaaatgtgtgaccttggacaagttaataatgtctgtcaacctctgcattagttagggtgatgctaggagttcaacaactaaacactagtatctcaggtttttaaaacacaagttaatcatgttcatttaaagtccaacggatgtacctcatggacaactgtctcttctccaagtagaaattccaggactcaagttccttccatctgtggttccactgtcttccacgagtggtgaccatgggttaagtcagagaatggaaaggagaatggaagagaaagtgtggtgaagttttatgggccaggcatagaaataaagcatgctatttccattcatattccattggcatgaacttggccctgccacttcatttcccactttttaggtagagtgaacaaaatggtatggtgaactctagaggaacctcttaacaatttctgccacagccttaatttccttttgtaaaattgagagaaaatctaatttgtagtgttttgtgaaggttacttgagaaaatgcagatgacaaatttaggagaaatgttttcatattgtaaatatttactaaggagtaaccattattagttgttttactagttctcatcaacatcttcctagcagcaagcattaccaatttctaggaatataaattaatttaaaaaaagacattccaatgagactatagcttttccctccccaacccaacctgttccagagtctactcattcatttgctacaaagtatattgtagacttactatctgtcagaaactgttctctctggtgaaataacaaagcgtaagctctgatgcattttctcaggagctcattatactagaagaggcagaacacagatgggaaattcagatataatagtttaggaatgatgaaaaagataaagtagctaatgcacttagtagatttcttgccatgttataagcaatcaataatactaatagtgacataagtgcaggaagccattgttgcactgaaaatctactaaacaagcttacaaaatgaagtcagggaaggaatcctggaagatacgggtgtgtgttgtggtgaggggtggggatgaatactaaagaaagggacacggaggtattcctcctgctaagaggatgtgataagcagaagcacagaggcattacaaaatggaaatagcttatacctgaactagaagcctatagtgattgtgggaacaaagaggtttagaatgctttgtatgatattttaaggagctagattgatttctgtaaacaatgggaagtcatttgagaggctttaaacagagaagtagcatagcaagatatttgctagagcagtgagaataacggatttgaaaaacataaggctaacataaacaaagagcagttagagaacacgtgtaattcacccaatgtaaggaaggcaatgaagttatgagctagagcaagatggtctgtagtattctttctaaacattaatgactcaagtctaatcatgagaaaacattttgaaagaacaaattccatattatatttaggaagtaaaataatcaggacttaataattgattgtataggtgagctgatagagagtctaacttaaatggctagatgaatggtgctgcagttgagactgatcaaaaaataaaataaaaaaaaaggagagacagcaatctagacgggatataaagagttcactttttaacatattgggtttgaagcaccatgcagacttacaggtaggagcattcggtggggagttaaacatgaaagtctgaaacagcaatctagggtgaaattatcattttgagagtaattactattttagtagtagtgaaatcttattccttcctggtatttgctttgaaaatggttttagcacttaactggtagaaaaattgatttttttcttaagtgaggaatctataatcagtcacatcaaactcctaaagtagtagaagtaatgagaagaagtagaaaccaagcctcctaagaaatattttcatacacaggcactaatctcgtttaaaattgcttccattgtcttggaagggcctagaagcagtgccacttctataccctggtagcaatgagcgtatctggcacccacatcacaattctaaatactgttcttcaacaaaaataactatggatccctagaaaaattgcagattcaaactggggaagagagaatacacggtgaatcgaacattgtgtagtgccagaaaataaggaagtgctaaaaaatatacggtatcctaacaaaagaattagctaaagctagatcaatttgagaaacaaaataaatgacaatagtatcgaataggaactgaataaatatgaatctacgctgatgtaaatgaatgaatgaatgaattagctggggaagatttcatttatagaagaatttcaaataataaatgcagaataaatgagggagatagaagaaatgagggagatagaaaaaaaatcaccactagaataccccagtaatatttgctacagccaagctccattgaagaatgttaaaattagtggactaaactttaaggacaaacaggatatttgcataacctaaatataacttccccaaaatacttattaattaatgtggtgatttgaactcaggcccacaaattctttgatattcctctctcgggtggtagagattaatttctctctccttgagtataaactgtacttagtgactttcttctaatgaacagagtatgggaaaggaaaaatagtatctttacagtggagaaatctggtaaacatcaccttaatcaagtgatgaaggttaatatcaccagtgataagttatgttgatgttatgtaaccctagttagatacaatgagaagagcacttcatctaagcagcatttttcctaagtgaataatgcagtctaaccataagaaaacattgtaaaagaacaaattctacaaaatacttgcccagtactcttcaaggcgtcaaggtggcaaaaaacaaggaaagactaagaaacatcatatattcctaaagaagcatgacaactaatagtgatgtggtatgcatatttaatcctacaataggaaaaggacattagtggaaaaactggtgaaatataaactctgtagtgtagctagtgttgtactaatgtacaatgtacaatatacccaatctaatttcttagatttgagaaatatactatatttatgtaagatgttaacattttcagaagctgagtgaaagttatgtaagtaccctatataatattttactattctataaatctaaaattattttcaaattaatttttttaaattttctgactagtatcagaagacaaatacggagagcattatggaactaaactatgtgaggaaactttaaaatacatatatatatataatgattattattatcaaagccagttctgttatataaattcatttacagtcgaaagggagggaggataggaacataaatacaaaaaatgaccaagcaaatctcagcaaaattccaatagcctccccctccacttcatgtttgagcaagtgagagaaaatcattagttcattcaaacttcatccccataatattgctcctttacaagtatccttgcagtccctgtatctgacaagtctacagtaccctatctaacaaaccaaatgaaggtactttaaggatctattcattcattcaatctattatttattgagcatctcttatgtgccaggcatccttccagatggttgggatacatcaatcctagttaaaactggattagacaatacacagtacataatccaatcctctgattattcagataaggaaactgagatcacagatgtaaaccaaagtcacagagaaacttaatgtcagaaccagattagaaaccagtctctttttcaccagccttctcaactcaaacaatgattctgggttgaggacagacattgagagaggtgtaaatgtgtttgttttctctataactaggaaatacttcttcaatctaaaagggtgatttcagttcaagataatgatgcattcaaagagttcttgcttctagcaatctttattccagaaactggaaactcacacttccaatttctgaaaattcttgttaggtaattctcataattgttccacctttcttttttttttcctccagaagtgaaaagtcaggcttggaaggttaaatgcttttttgagctcatttaatgagatagtgacaaagctgaaaatagaagtctcctgattcctcatgtttgccttatttcacctcatgttatcacactgaattaaattatatttttctgtagtactctatcaggaaaaggtgtcctgaataattgtaaagcatgggggataaaaaatctaatggagctttattatttatttatgaacccaaaaacatgaggatattcagtttacgttcagaggacaattagtaaaacgtaatttgtagaactaggtctatatgactacagtaagtgggaattaaatatttgataaataaagcattctggaaacattttgaataccacataaatacaaacctttcacccaaaaaacataacgaatctagtagtttgaatctttgattttgccaacaagaatcaaaatacattatttggcaatataagtggattttttaataaatagtttaacctaatataagcatttgagtattaacatttgaataacctaagcagaaaaaaaattgttttacttatcatttagtgaaatccactaattaggaacaactgtagacgaccaatagtgtatcttaagattaattctttttcttgggaggctgaggcaggcagatcacgaggtcaggagatcgagaccatcctggctaacacggtgaaaccccgtctctactaaaaaatacaaaaaaattagccagacgtggtggcgggcgcctgtagtctcagctacgcaggaggctgaggcaggagaatggcgtgaacccaggaggccgagatcgcgccactgcactccagcctgggcgacagagggagacttcgtcttaaaaaaaaaaagggacccaattttaaatggatctaaactttctaaaaagaaaagaaagtaaataattaagcaacaaatacaagccatgtgaaaggaattgttttaaaaaagatttttctgagtgctatgggtcagtttgtggatgggatgaatgctttaaaaactgttgctcaccataatgaaagatacaaggtactaatcatcttttataatttcaaaattcaccattaaagtctagctgtgcccatatttagacactcacattttcctaattttaaaaaatgcacctgtagcagaattttttctccaaaaagacagagccagctggagagagagagacaattaaagctgattggatgactcagcaataaaaataggaagctagctggatgagaaaggatgagctgcaaggaaacagattgccagggaggggtttctttgaaaaaaagaaaaagagataaaaaggaacccatcaacatgaaagaaaaagagataaaaagaagcccatcaacatgaacaccaggactgaagttagacttttcagctaatggagaatccatttctgaaattaaaagagtaaaccgtttattcatggtcaaattgtatataaggttatacaattaatacctattatgctttcgtaagtagtcgatagaacaataatgataccgaagcaggagtctggtatttatcaaaggacaactaggcctttcttccattaagtgatggcactccactccttcctgcagcaggaactagtgtcttgtccttttgccgggaacatatctccttcctctttctcttctcaactccccactcatcactcaaaactccaccagcttcatgattacacctagccaaagattaattttattcttcagactgtgtcagtctcctttcataatacaccacttttcaaatactgtctcctccttcatagcccaagaatatatgtgtttaattttaatgtttttaatatcatgtcttatgttaaattgtaggatccataagaggagaactgtgtctttctccttgacactgaacaagcaggcactcagtaaatattcattgctgaatgaatgattcctggagagagactaatgagtcagagatgcaatcctgcctgccactaatcagttccattatttttagacaagttcactttgtctcttcatgtcttagcttcccctcacatcacttccatctctgagactttcataaataggttatctaataccctttgtttgatttagacatgagattctcaagaaactttaatctcaagtactacaataatagtatcctcaattcttttcccatcttctattatttctgcagctgggtaaaaaggcagttcttctttcaggtagagaaacatctcctcgtgtttgaagtaaagaatcctaactattataattcaaaagtgtgatgagatcatttaactattcattcaacaaataatgactataaatttactaactcctttacgttgttttaggcaaagaggacaacacaataatgaaacaaaatctcatgttcctagagctctcattctggaagagagagagagaaacaaatgtatactacatgaagtgataaatgctatgaacaaaaaatagaacacagcaggatggatgagtaatgatgaagagaggattattgctttatataaagtagtcaaggaagatctcaatgataatttgacatttgacagagatttgaaagaagtgaaagatgagaagatacctggtgaaagcatattcctggcagagttaagaactcatataaaaaccatgagtcaagggcactcttggcaagttccacgtagtgcagggagatagtgtggctagaggaaataaacaaggactctgtaatacaaggtgaggtcatagaggtagccaagtcagataatgcaggaccttatgggcctcttgattagattagaggccattggaacatttgaaactgtgagatgctatgatttggcttaggctctcaaagaaatgttctggctgctgtatgaaacataagcctaagtatggcaagtgtagaagtaataaaacacttaggagggttacaataacccacgcaagagattatggtggctccatacaatagtaagggtatatagctggttagaagtggtcagactccagatttattttgaaaatagagccaatgcattagagatggaaacagtgagaaagagtagttaagtaatcagtggaatagaatggactacaattgacagtgaggatctaggaatgcacctatttcacttgcataccctgagaatgagcagaggaaaagagaaagtcaccacttgcaagggctacaggtgaagcattgcccctcaagtgtcactgggttttggtttaacaggaaaaaaaagtgagtgggatatttaaagaagaattggaagacagagggattctattgatagagacctcaaaacccacaggacctagtggaaagtgtgaaggatggggctggagaggggcattagatggggtcagaatcatggatgtatggagccatttgggaatgagaaacatctagtagcctgggccctcttgtgtttatggaggcaagcagggatgtagggcacactggaacaagtctagatggtaccttaggtcaactgtggtaagtaatgaggctgggaataactctaggggaaggcaaggcctcttcttgccatgaatctgtggctttctgagataatgagaaggcatatgcaccctcttctgtcctcaggctcctgttcaaaatatttctcttagttttcctcataaaattgtttgatctaatagtgtgtagctgttaaagcaaggctacatgttggtattaaaaaaattcatctggctgggcgtagtggctcatgcctgtaaccccagctctttgggagccaacatagtgaaaccccatctctactaaaaatacaaaaattagccgggtatggtggcaggcacctgtagtctcagctacttgggagactgaggtgggataatctcttgaaccttggaggcaggggttgcaatgagctgagaccatgccattgcactccagcctgggtgacagagcaagactctgtctcaaaacaaaacaaaacaaaacaaaacaaaaaaaactattaatcttcatgtacaatatgtacaattagtgtcagtctgccatttcctagagtatttgcaaagataaggtagggcaccccagtccccaggcttgcctcattgtccatatcttcctgatacctcataccaataccaactgtgcctagtaccttcacatattatagatgctattgttcttgattaggtaagagatgggaaaaaaaacatgaagagctctaatttatattttaacctataaaattatagaataaaaagcactctcacctgggaaagagaaaactttaaaaaaaagaaagaaaaccctacagcttttttttcaaagtctaaaagggatatgaaaaacatagaacagtaatgtgttaataaaatagatcaattcagtgcgaataaaataaaatttcaaaattgtaatgagctaagctttggcatagggtacttagtaaaatgtattattttattgcaaacaccaaaaccaaaaccaaaaaaaaaaaattcattgtcttattaggacactattttgatcattctctaatattaaatctttgaccttgtttacatagaaggcacatttacaacaacatgaagaaaatttgggatgatacaggcaaaacttttgtgctcacaattcacaacaattcttttatgtgccaggaattgtgttcaggtcttgccttggactctttacagagatactagctccttcagtctttacaacgttcctatgagttatctattcttaaccctactgtatagataggaaaatatacacttctcatgatgacaaagctcattagaagcagaaagaaaatttcaacccaaatcatgtgtatgtcaatcacaccactttgctgtcacttatcaattttataattgtgaaagactattaatttcaattacaaataaacatctaataatgcttctttgttgaaaataattatataactatttagaccacctcttctgaatattgacgtggaaatcactgaaatactacgctcagcaatgtgctgctcctgggaaacatccttcaacaatcactcctgagtgctcaccatgtggcaggtaatatctaagcactgagaattgtgtactaatcaattatgaaccagccagcatcctactagagacagagtagcaaagcagtaaacatataaataaaaccattctaaatgccaacaaacaaagactcatgatgtgaaggtaaatgtaaaggagtagcaactttagctaaaggtgttcaggaaatatctatttgtgaaggttaagatctgagctaagattggggaggcagagaaaacaaccaatgtaaaaattcctaaggaaggaccaagcgtcaaaaaacagaaataagtctaataaagctagtgaatagtctgcaaaaggggaaaacaatacaagctgagtttgaaagggtcagcagggaatcattcagggccctggtcaagttaattctaagttatcagaaggtttcatttggaggacgcagagagttataagatccaattaaaaataaaaataaaaaaacctcacagagaaggtaatagtttcatatacttatatatgtatgtgacatacatatgtatatgattaccatatatatacacgccatatatatatatacacacatgccatatatatatgtatatataacatgtatatatatatatgtatgtgtgtgtacatatatatataactgggtccattcattttcctgcacttctgttccaaatatatttctcaaagtcaaactcttaagggctgatgccaaataagatgactatgccttcaggcaggaagaaatacaattccgtaattctggtaattctgattcatcttgttctttctgtctagatgacagttttctttttggtaactgacattgaaatatagaacctgcaaaatcagccatttatcacaccaagtcactagaaggcttcacatctgaatagcaggaatgttgcctcttactaagtcacacatgtcattttttctccaaaataatctggatatgattgcatgtgatcagtttgcatcatgtgagaaagatgtatagtgttctccctcatcctcattatgatttgcattatactgagccatcactccaaatgctccattatggacgaggtgcaaccatggtgattttatttttcactgatctggggaagcaaaagagactgtcatcaacagttgattatggcatcctacatttctgctgtaacacaaccctgaaataacagtagatggcaaatttttaagtcactttttgtcaaaataatacctatcatgtctactttgcaccacatatatgctgttagaagaaaataatttccttctttataaaataaaatctaaaatccccatttcagggtagagtcaagataagagtctatcatatatagttttatctgtgaatactatgtttaacttcagggaaaatagacatgaatggaaataaacatatatttactttacttaagtggcagggcattatccatgagcttgtgtacaagaaaaatgtcataacataatcataaatgtggcatttattggaaaaatgatcacctccataagccatttacaaccaaagtgtcaacaatactcttagtttctttgtgaaattttagataactttatttaaatatatcaaattttattcgtgaattctacaaaagcatagacgcaaataaataataatggatttccacaccagagtagagaactcaaaaactagcagctttttgaacacttctgtctacagagagcactggaacattggtggcataagcaaacaataaattgccaagcaacttgtattttcatacattgttctttacttctcttggtgtgataaaaattggtcctctcaaggtagagagtgactggagtaaaaaagtgaacacattagtgtctccctaacatcactatttcacatggctcacatgttcccacaccatcaaaagcctaaacctgaataatgcaggccctggccctgcttactgagaatactcattactattattgttttattatctaggttgtaaactctttcataaagctctcaaaaaatcacctacttaaaaaaatcacaaaggaaaagatagaacaaaaactgctaaaaagttggaaaaaacttttctgaatctttgtaaaaactttggtgaatagaagcatattaataagtatacaattcaggataaaatgcttattagtagagaacaaaaacattaaaatataaatgattttagtattacaattaaaaggaatagattttcaggtttgataaataaaaagactcaactatatattatctacaaaaagctcacttgaaacacacacattgaaaataaaatataaggctgggtgcagtggctcacgcgtgtgattctagcaccttaggaagccaaggcggtgggtcacctgtcaggagttcgagaccagcctggccaacatggtgaaaccctgtctcttctaaaactacaaaaaattagtcgggcatgctggtgggtgcctgtaatcccagctatgaggctgaggcaggggaatcacttcaactcaggaggaggaggtcacagtgagctaggtgagatcatgtcattgtactccagcctgggcaacaagagtgaaacttcaactcaaaataaaaaataaaaaaaaaaaagaaaataaaagaaattattaaaaaacatatattatacaattattaaagtacagtggcaatattaatatccaacaaagtagacatcagaggtaaagagagtcattttatagggataaaggcagcaattcaccaagaggacataacaatcctaactatgtatgaaattaacagcatagcttcaaagtatctacaataaaaactgatagaactgaaaggggaaatggagaaaggcaaaatcattgtttagtatattaatatccttttctcaagaactgtgagaccaagcagtcataaaatcagtaaggatatggaagatttgaacaacattgttaattgagtaaatttgacctaattgactattacagaacattctaataaataatagtagaaaaacatattttcttgagtgaatatagaacattcactgagacagaccatattcttggcaatgaagtgattctccataaatcagagtaaggtgtaaaactcaaagataattaaatatatgatagtaatataatttactggtagccaaagaatcctaaagtagttaatttgtaagtactttctaagtctgaattctttaaaaaacaaagtccaaacaaaagtaacacattataagcaaaatgtacatattgtgagtaacacttaagatctgggttttattgcttgtatttcaagtgttctcaaaatttcaagtcagtaagttttccttataaaaaaattactcttattatatcatacatttataagacatgctccctattggtttagacaaaaaactaaatcttaagaattgtaattatcttaagtgtgaaagttaggaaattaaattatgctaatattcatccacaattaataaattattaaactcacactaaatctaatgttttgaaacctgaaaattggtacttccattaatggagtaatgtaaattcctattaaggttgagttcacttacaaaaagtaagtaaaataaagattaatttatagttgatataccccagaggctgctctgagggagtcccccagggtaagtgccagttcctgctaatacctaaaagagtgtctatcagctttctaagcaccttgtgagcttgggagggagatcatatggtagcaccatcatcggccccctaatgcttccactcttgttcaaattatagcacacgccaatcaatagggaccctgcctcaaatcttacctgcctcttttccaaaactagtatataccagtttcagtcatatttaagcagagagggagcaaggtctattcaagattttgaacaacagagtatggatttatatcctggcactataatttactagctgtgcaatatggggaaattgttaatctctctgtgcctcaatttcttcacttttttatggtgacaatgatactacctacttcatagagtcactatggggcctaatcaaattaatatttttaagagcttagaatagcatgtggctccacagtaaacaatgtgtttgctaaaaatatcatggtgttgcctaaaacctttcaaagatttcttattgtcctcagggacaaagtctatactctttaatttgactttcaaaacaccaacttatctttcaaacctcatctctgtatacctaagctatgaggacttaagtttcttgaaaaatcccttacatgtctttttacttaaggaatttaccttggctagaatgtatttctttggctttcttgataagtcctagtcttcttataagtcttatttcaggtatcactttctccctggagccttccttagcctctaaagctgtgatacatcctcaaagagaactgttttttttaaattttttatttatttgtcttttactcatatgactagactttaggctatttaagaaattaatttttgtgtattgttgtaatgtatatgcatagcatatgagtccaatatatatttattaaaaaaatgaataatcaattaatgggtcatacaggagctatattataaaaacgtagatcacatttcctccactatgacctcattagctagctagatggttgtctgggaccaaaaacatccatgagagaaaaacaaagagatcaacctggttggtgattttattttgaacagttacaaaggtaatataagttagtcacaggcctacttggtgatccgttcaagacataccctgtctccatctctcagcaagtccaactactgaagtaatgctattaagcaaattgcttcagttctctgactcccagttacttggtaggactgttcttcttgactttcttgcagttggttgaggccatgtgacattttggccaaaaagttataagaagtgaaatatatcacttctgagtctgattgtttaaaaccctacagagctatctatctccctgtcaaaatgactggcagtggtcatgatggagctgcttagtcagtctacatccaggtatgagatgacaagaagcaggaccgctagcccacctatgatggttatgtagtgggagtgacatattatcatttgctgtgagaagctactaagatatttttgcctgcatgataacattcccaatattgaaaaaaaaattgtcttcaggaaactattgacaactcacagactacatactggagcatgtggatcaagatttctaaaaactctgggaaaacactccaaggaaactctctcccaaattctatgaaatctttgtattattttgtaggctcaagtctgtaacaataacattctttgcatgacagagctatgaggaaactattttgattgtttctttggaaaaaaatgaactttaaaaaatcatataatttaggagaatatgtttctagaataactattgtaaaattttaacaaatttaagttgtagttcttaagctgaagcatttgcttttcatgtcaaataataactgaacaaaataaattatcatccagagatttatactgggtagaaaggaaaataattaatctgatacgtttggtcttgcaagttgagtaagatactttgccaatttggaaatgttctatcttgaatttagtcatctccttaattgcttttattttttatacaaatgttgtgggtttttgcagttttgagaggcagaaaatgaatgatatagcaattaataaaaacataaaattaatggttcttcaactaaggggtcgatcatactggtttcctcaacctcaatactccattcttcagttcaaggtacaatggaatttatagcagcctgagtctctgaaataggacttccttgatccaatgctaatgttccattgtgtgtgtgtgtgtgtgtgtgtgtctgtttcctgataaggcaattatatttattttctcccagttataagaaaaatgactaatagatattttgctgacaaactgttagcaaatcttctggtgagaaatgtgacaaaagaggaggatgaggaaaaaattctgcttccataaaggtaaaagtggttttaaaaattcatagtattagcaagaattgtttttcttggaacacagagacaggaattgatttcctaagagtacgaattacagctgggatcctttgacctctcacttattagaaaataggtattattatctaacccgaaattctggttaatttcactgcctgctatttctcccccaaacaagagtaacaacagcaatgacaataaaaacaccatcaataaacagtcctacaactgaagagatattttacaacagcttttggtggaaagaatgcattggtttttcaaacagaatctatcaatacatggattctctgacaatagccacaacagacacaggtgttggaagtgactccatgctgaaatagaagctggggggtacaagtaaatgaataatatactcatggaaaatgtgaagacaagtgaagcattttgaataaggtaagtgttttcagaactacaggataactgatttgctgttggtcatgcaagtgcctgaatgcagcagtttcttgataatctgttagatatttctaattgtttatttagtaattgtgaaaatttcctggttaagagtctcctacaagggcatccatactacaagaaaaagagagagagaggaactaggttcactttttgttaagttctctgactaaatgcagagtttttaagactgcctataaaattaaaatatattgttatttctccctaaaaacaacaaaaaaaccatttaaggatctttcaaaaatgtgtatgatttgaatgcaaatgaatgtctcatattatattctagcataaggaagttattttgcaatctcaaaagcatattaatattattttaaatattttttttaactcaggaaatctcaccttttagtaaagcatggtatgtaacagcccctttttatttcaattgactaatcaaaggattgtaatcatctggccaaaacatcactattccccactcctgctctcttagaagcctttctaaatagatagtggaggtctttccagtggagccaaaatgtggctttagagccattctcgaaatattctattcaataattcacaatacatgagaattcatacatatttgttatgatcatttatttccttttctaattcctccacaaaaatacaaattttcttttagcaggggttactattcatctttatatcagatagcacagctcagcatatgatatacatatggccaattaatatatgattaagttctatatttgatattataaagatatgaaattttcacatgaaagtctctcatttttatttcgtatagctagtatataattacatatgcaatgtttaactggttgtataaaatcacatatctaagaaatgtagtactaaacagagttcttcaaaaattgcagcattttaccacgacatgtgctcactaaaaatttttttcaccttaagtcataagcttacctactttcaagccattgaaaatgtctgaaatatatgaaataatgattcaactaaatgagaagggtgaaggatttagttggttaagttcccaataacacttagaaacaataaaacaatcatctttgacattaggcaaatctgggtaatagggcggcaggaagacttcagcaaaactgtgaatttttaaaaatttttattgcttactggtgccctcctttctcctctgccagtcaatctaaacttatcacattctagatgaaccttctgctcatacaaatgaacattctctccctcagattgtgacactcacattcatacacctatcctttctgtataaagaattactctcagctacctgtcaaccaacagcctgctaacatgttacctagtaatagcttaaagtatatttcatatcttctatgatactcttgaagatgataaagatcttgaaacataaattaatcattcccaatagtgaaattttagttattaatatcacaattcccaagaaatgtttgagagcagaaaactggtcacttagaacttcaagaatccattactcataacctagcagtcaagagagtgaatgcatctactaccttgcaatctatacatcatctaatattattctaaagtcagtgtttatgtgagcctaaaatattacaaatctagaagttcttcaataactctttcccaacacattggtaattactggcactccttggtaatcactgttattacaaagttgtctcgcttctacaacaaatatgtgtcaggagaagaaagaggagtgatctttactagattaaagattatctagagctacatttctctcaatttcagtctagataaaaatgagaaaatatgttttaattgtaccagattgttaaaagctatgaattcgaatgcttgtgattcattgccagttaactgaaaggagttgttctgaacatttatccttctccttagtatcatccaaaatgaatattttcacacaatgaagaaccacttcccacactaagaaactgtcacactcacaaagctagttgatctcccaagcattactgctaggtactgttaggtagttatagttcctggattctaaatttaaaagcacattttaccacaatccagattctactattttaatctcagctacgatccagaatattgaggaagaaaaaaatttcattctttcatagattctgtgaaagaatcagtgaattaacttgacaagctaattatatcttatataaatatgctctttagactttcaattttagagttcacaaagcactttcatatgaattttccatttatcattcacattttttaaaaatgagaaaaatgtctgaaaatgacttgcacaagatactcctgattctcatttcagaattctgaattcccccattctcaactcacatctccacaaaaacaacaaaaagagcaaaattgaaataattattgtaaaaattcccacctataaacaatctcaatgggaaaccctttctgatcccactactcctgacttagataggattgtatcaaaatagctaccattcctttattttgcagctgcttcaaattatctggagccctgggaccagtctccagaatccttccttactcaacgtctactttcactttaaaatgtaataagaaaaagaatttagctgtcttaaaaaatggtctaaatggcagacttaactcaaaatagccaccagaattatataaccaaccaaatgtatttccttttcacactaagacacgactcatctgatacaaaatctaaattgcacacatcagcaagacagaaaaagaagtcaaagcaggtctttctcagccattacctgttgcaactgaagggctctaattttatttactcttgagctttcataatacagttacagtgcctcataaattgactttctgtgacaattggtgatatacttcaaaaagtatgtttatatttaaatcaatcactcttttgaaataaagcaggcataatcttgttttccaaattttaaattagtaaaaacacctttgacattgaatcagactaaagtgaaagactggtttattagaaaatgatagtaaaaaagcatgtattttccctttttcattagataagtatatttaacattttcatcagagattagtttgagttcacctagttatttgtaacaataaaatattcttggatgtcactgtacccctttccaatgtccatcatgtatcatcacacctttcttatttgtagataggggcactatatacaagaccaactaaagtgactcgttcaactgagataattactaggataattaaagtaacccatgcttattataaaacactctggcaattaaaccagacttcaagtttaaaccagaagcacatcacaaattttgtctccaactttcataaaccaatagtattagcaactttcactctaatagcacacaaatgagtctaaaatagcagtagccataatatatatggtatctgcatgcacagagaaaggaaaaactaagacatctattcggaaactggacaaatgtaaggctaaatgtgctttgtcctaaattagcctgattcatctgctgcttcagttcttcagttggtatattttggggataagtaatgcataataagggtcaggcacactggctcgtgcttgtaattgaagtgttttgggaggctgaggtgggaggatagcttgaggccaggagttccagaccagccaggacaatatagcaagaccctgtctgtacaaaagaaaaattttttaaattagccaggagtggtggcatgcacctgtaatcccaattgtgtgggaagatcccttgagcttaggagttcaaggttgcagtgagctatataatcccaccactgcactttagcctgagcaaaagagcaagaccctatctctaaaaaaagagtaatgcataatagtatttataattctttcaatatctgacagggcaataagcacaataaagggataacaaactcattttgagatttttatattttaaattcatagaaacattcataatataacttaaatttcaataaactttttagtttcaaagtgtatgttcaacaataacatctcatttgaaccttagattctatgagattggacagaaaatcatcaatatccccatactgtcaatgaggaagttgattaatttttccatgatttctaaattcccttggaagatttcccagactttgccacttggaaggtcatatagtttcacacttaggtatgaaagtggccatatttagtgtgctttccctagaacctctcttctactccctaccacacactcatatacaatacctttctcttggctttgttgtttacactataaatgcttgtaatactggattcaagacattgttgttttatttatcggtttgtctatttacatgttttcttttcctgctgaattgaaattccattgagggaataactgaaatcatctagcaagtactttagagcccagttatttccccgacactatgctaggaactgaagatgcaggaaagctatgatatctgcccttttggaatctaatatgtaattgtaaaggcacagatttagagagattacaaattgatgaatgttacaaagcagaagcacaaggagctatactagatccattatagatggaactaattgtgtctgagagattagttaattctacctgaaagaagcaatgcgtaaataaaatgagatggataatctgaaactgttgaaaggaaaaaagttctagaaaacatgaacacatattttcatgaacatgaaacataggatttgaaatgtggtatttggcaaactaaagaggttcaacatagttaaagaatatgagcaaagagtttctcaggttgagggagtttggccagaaacaaatttcaaagggccttgaatattgcattgtatattgacagtaatgaaatgttacagaaatattttcagcaggtgggtaatatggtaatagttactcttcaaaactaccacttttgagttcctgagaaggcaagcaagggtgaattttaaaatagttatgaatggagaatagaaatccaaatgagacacaaattggcttggactaggatggtgataaggggatcaagtgaagaagttacaggattccaaccacaattgggaagtagtagaatcagtaggacttggttatttcttagaaattaaaagagaaggagaagaacactttttagatttctgacttgagcaacaggaaataagggaaaaggagatttaaagaaaaaatgaacctactgagcttgaggaactcatgagatacctttgtagatgtcactgagtcatgtggacattgaggcaactgggtatataatttagaaacttggatatcaatctgattattatcaacatatagccatggaattatagaaaaacctgcaaaacaagaaaacagattgggacaaggattgggctaattaagaaggctgaatgttttaatcttaaaatgggaagcatgaacatttcaaatcagatcttatattctgacatttaactgagatttccatgtcaaaagcactgagatgatacagatctgccacggggcgctgaccaaagagcattcataaaattaagccttacctctaacatatgtatatatacaccacgcacaccctgttaaaactttttagttgtcttggggctgggcgcagaggctcatgcctgtaatcccaccactttgggaggccaaggtgggcagatcacctgaggtcaggagttcaagaccagcctggccaacatggtgaaaccctgtctctactacaaatagaaaaattagccaggcgtgttgggggcacctgtaatcccagctactcaggaggctgagacaggagaatcacttgaactcaggaggcagaggttgcagtgagccgagatggaaccaactaccctccagcctgggcgacatagcagttgccttgacttaacatctcatttccaaatagaactcattacattgtacattaaaacttcagcatatctgttaagctatcacattaaaaagtaaataatataatattgaaaacaattatctcacaatactaataattgtttagagacggaacttaaaactctgtttaattggagaagaaagtatagttagaaatcattttacatatacgaatatccatagtcatctttttctttttttcaagaaatgaactagccaagcaaatagatgattctaggagagtgtaaatgaataacttcaaagaaaacagtccggcattttaaaagatagaaccttaaagtaacataaccaatagaggacacctagtggtctttagcagaatcaatatttgcttgcagaaaatatcaggcaattcacacacatgcaataatgttggtgtcagtagatgtgctaatttcagaaagatgtcatcatatatttataaatattacagaaatatcagtttaaatatttcagataacttccatatgcttcatttcatttgaacttcacaactgtttgattgttcatgggcataaataagtcactttatgtgattttccctagattacatagaaaataatgtcgcagttgaaatatacactaatttctggtatagaatccattccataccatcataaaaattgaaacctccaatataattgatatttaaaattgtaaaacactgcaaatagacttcatagaaggccttatcatatttcattaaccgatacaaacattttttgacagcaagagtacttggcaaagataaacctttttttagctatctaaaaaagtactgtgtttgacaccgactgcatacaaaaaaatgcgaggaagtgataaacctctcttctaactggtggtgttagctctatccacggtggcctccaacccccttcattctgtagcactctaaaatgtaaatcccctgcctaaaatgtatcaatggcaccttttgattaagtccatcattagcacaaattctggtctacatctccaaactcaatctgggaatctgcatctactgcactaggctgcttgtatctcgtgtcttctggaacacactcttctccctggtccacttgttcagcctggtaatccattctccagattcaaaattcagttcagtatgtttcaaggcctcctcttgtgcaaagcaattgtgttgctcactcccttatttgtgccactacttcccacatcatctgtgattatttgctcacatctgcttttcttacaaaactggcatcagtcttctatccttatttgcagcatctccacatacagattactcagtaaatgcttgggagtgaagaacggatactctcttattattatttaacggatttagaacatgggagattgccagtatttagcggataaacatgctctgattatttattgtgtttataaccctgcactaatatacaaaaagattcaagggcaaaatttgacactgattcttccctatgatatctatgtctggcaaaaggaaagcaaaatgtgtgtaataaagcattagtaaccaaattatcatgaacaaatgcatgtagagccagtagaaattttcactggaaaggtattgactgtcacgatagagtgtgtcaatgtagaataccttctggaaatgagttgaagtctgattcttttttttttttttttgacggagtttcactcttgtcgcccaggctggagtgcaatggcatgatctcagctcactgcaacctccacctcccaggttcaagctgttctcctgcctcagcctcctgagaagctgagattacaggcacccgccaccatgcccagctactttttgtatttttagtagagacagggtttcaccatgttggccaggctggtctcgaactcctgacttcaggtgatccactgcacccagccttaactatgatttttaaaggagtgatagaaaaaaaaaaaaaaaagcctttccaaatcggagatgtagcaggaataaaattatagaagcagaaagaatcatttcctgcaagcagcactgtaaaactgaaacacaaacagaaaagagttgggtgcaaatatgaagtgacaatggtgagaccagggaacaatgtgctggagagacttgaaggcacagcaaggaaacacagatttgatgtgataagcaatagggagcctctctaagttctaatacagggcaggtttgggaaaactctgctgtttgcttatggcaagtcttagaatcctatgtgtttttaaaaatataaaagtaattagaatatgtattgtataattatagataggcaatttatagtaacagttagtttctactctacaccaatttgaatgctaaaattaaccaaagatagaaactgtaatctgcattagctccctatggaataaatttccttattactgctctgttgttatacataatttgtatattaaactatctctaagccagtataaaaatctaatattggtttcaagacaagcattgaaatgttcaagacacattattcatctgaaattgctatagatacaaaagatcaaaaccacaggccctctttcctgtcccaaaatgtatttaattaattgtaatatgtcccagttctatacaaaggaggttggggagataggaaatgatgaataaaaagtaaaatattatagttatatattccaaagccatagttattatataatgatgcatttcccactttttaaaattaagaagaatttatgctttatctatgacattaagtcctacaaagagataatcattacagagtagcatttgtatttgcaattaatatttcctaaacctctaaaaaatttcgaaggtcatctcctgttgataaaatgactgagatcagcagctgtaaaggaactcttcacctttacaaactgaataatctcctattcactaagcccttaatctactctttatctcttcagtggcttgtgattgtcacatattccatttaatttccagggatttcctcaccgtatgtctcttttaggaagatcacaaggaatttgttacccttgtgataggttatgaaatagcagtctggcttggatcactgtctttaaacacaataacaacaacgacaatgctgaattcaaataatagttttttaaaaccaaacataaaaattggaaagattcacctcagctttctagctattacaagaaaagaaatttctggcttgatttatctaaattgtctctggtttttacctcacctggcaatatatataaagtttcagtgtaatgtcacagaaagctatttttacatcccaaatctattgatcttataattggttcatgaaaacaacttccctcctcacttcttaacaccatgtgtttcataaattagttgctcaaatcagttttttcctcctgtattaaccactaattcagctttagtaatgataataacataagcacaaaaatttaaagcttctgtatctcattcataatatttttctaatttatctggcatcagggcttcttgttgtttttcagttgaactaattcagtccagaaaaaaaaaaatgtattgttgaagatggaagcagcttcctatagaaggcagcagctttcctcaggaatgattcatttagaacagtggcagcttccagacttcacacattacttccccaaatttgctgaatttagcattagccagcttgatactaaaacacccagaaccaaagacatgtgggtgaactcacatcttcctctgaatttttattgcaaaagctcacagagctactttttctgatttatttgttgtatttttacttgtaaacacatcctggtgacatttagaaaaatcaggtagagagatttccagttttggaaccattcaagtttcttggagattatggttagaaacatgtaggtgatggaaagattaatttgtattaaattctggattatgactctgtttcttccctgttgaacagcattactaatgggcattaaatacccatgatatatgatattatatgggggtatcatataatcaagaaaacattcttcacctaaatgggcttatggttcatttattaccaaggtcatttatttataagaaacatgttgccaacccacaactctagcctgaatgtgcttggttaccaaatgtctgtaagtgcatattaaattgcattttacaataatgatagcagtgagctgatgttcctaaattttatcatggcatctttaaaacacatcatgttacacagatctaggtgcctgtaattactgccagaagccaaaggacattggtggtaaggagtatactcttatatgaccacatggcctgccattttatctgataggatgccatctgttcatcctgctgccattctctagggtaactgggctaaaaccacaagatattaaaaatagtcacattgctactgtatttttaattgactggatgtttatatcagtgactttcctctcacaggatatttgttaaaatatttttccatggccttgttttaagaggtactattcaactctgttgtattgcatggcccacagtcttacttaagaaaagttccctataattcgttagacaatctataaaatggtagaatattaagatatttataactaaaacattatatatcatagtaagaacctatatagttttgcagttaagagcactggctcctgagtctgattgccaagtttggaatcccagctccacttcttactagttctatgaatctggacgagttaccttattgtatttaattgttctcatctgtaaaataatgacaataattatatttacatctttgtgttgttaggaagattcagtgagctaatatatgtaaagaatcaaacatactagctgacgtgtaataagccttcaataaatattagcaattattagcaagaatcatcttggtttggtattaatctcaaattagcataaaaaggctttgagaactgaacatttattccattttagatggaatgtgctatatagagaaaaattacaagatgaatctgatttctcaaatgtgcttcatttgattttaaatatatcccatatctatattttaagaatgatccatttttatgcctttttatcagtgtattatgcagtgttttattattgcatgtcatttcctgaaatcctgtgaaccaaaatgtcactgacaagcacatacaaaaacactgctaccgcctcacagaaatcaaacagaacttccattttatgacatatttaaaaacataatttatcttgaaaatgctaaaaagtatttctgtagggaggaaagcaatattctatagccagtatatgactttatatgactttcattagtgtcgatttaggcattctacaagtcttttggactcttacgcttatgcagactataaaattcaggttataattaatacaaaaagacttaggaagaaaaggaagtcaaaatggttaatattcagactttgaagatagggatatgaactcctttgcttgatgatggtttaactcagatctttggaaactccagttggctgagccctctcaggtcccacccactgcctaacaacagatgctctattcagcaaaatatgggcctgattggtcagattcactccatttattcactatactctttgtgttttctatgtactaatgtccctcatgaatatgttcctttttagtattatgaaatgaactaatagggagaaactaaaataagttactataggcaaggcataacaataagcaaaattaatatgctaaaatcaaagcctttatatatacaatttggaaataaagaaacaatctgttttacccaatcatgaattcaatgaaacttcaatattagaggatacaaaaaccacactatctcacagagctaatgatgtgccagattagcaatcagaccctacacatctttatcaaaataatggtacttgatgtatttatattagattaaaaaaaaccaaggtgggaaaggggttgtattgatcaagataataattgctgattaaagtgcatttatttaaaaataaaataaattggcataaaacgatcactatttttttcagttcattcaaatccattatttgatcatatattttagggatacaaatatatcacttatgcatggaaaagagtcgtcgaatacatttttctacttgaatttcataaaactcattacacattgcacagttgttcattgtaaaacagccataattaacaatttcatgatatagatttaaaaaagaaaaagatgcatcttacctcttcccattgatgtatgtatctaattaaccttgaaagtcgtaataaacgcaagagactgagaatttttgtaaacctcacaatgcgaagtgccctggctgtcttgtaaacttcagaatccattcctttttctacaataagaaagatataatccactgggatggatgagatgaagtcaaccacaaaccagctttttaaataattcatcttgatcactttggggtccaggatgatttcagaactgtcttcattgacagtcccagtcctaaaattcatgatcaggtccaataggaaaactgtatctgatgccacattgaaaataatccatggtgttgttgtttgctctgtaaagaatgtgattccaactggtatgatgactagatttccaaccatcattataagcattattaaatcccagtaaaacctacaacaaataaaaaaatcagattttaagatatagaaaataaccagcctatcccccccatgaaaaattattactgatatatagtgagatcaataagtaaaagaacaaagaaatgattttattttttaaaaatgtaattccttaaatggctatatgtttaaatctaagtaaaattaatatattcttaaaccaaggcattatgattatggaattctaaaaattatgtgatatgaagcattatacaaataaaatcaaaaacattcatacccccatttatttagtaaagaggcaaaaaaagcaacctaccttatacttaatacaaaatatagacagaaactagaaagaagtataagattagaagatctgtaagaaagcctttgggaaggctctttgaagatgttttgaattattttagatgtcaatttaccaatcatagattagaaaaaaaaacccagaaataaataggatactctaacaattttagttatgcaaatttatctcaaggaatacagattagttttgccatggaatctagaatacactggagttttgcagtactccaaatattttatgctttatttttcttttgcttgaaataagaaaactaattttggtctgatgctaaaaagaactgagcaagttctactccatatttgaaactagaatctacctaaaatttgtgtttttattactactctattgaacaactacttcaaatatattgccactacttttccataaaaattctttctttctttcttttttttttttttttttttgagacggagtttcattcttgttgcccaggttggagtacaatggcacaatctcagctcactgaaacctccgcctcccaagttcaagtgattctcctcccgcctcagcctcccgagtagctggcattacaggcgtgccaccatgcccagctaaaaaaaaatctttaacatttctaatttaattctgaacatgcctatgactactaagtaccttttgaaatattcttatctcaacttacattaaaattgagagaaaaccaggaacttcattgctggtttatatagcttaactaaattaactaaattcacttgacataactatagtgttatttttataagggttctttcagtctgttgacactcctattaatcaaatatttatagttgttacagtatatacttgcaaaaatgaaaaaataaacacaactgtataatcatgaaatgtatccagaaacatgagttactttatcctagtcataggtatgttatttgaggagttttgtataaacaatataaacttccatgataaaaatgtctgtttaccaagatatttttgttttacatgaatactcctacttagactatttgagctacattttggtgaggtatacatgtgtataaagctttcaaagttactatcatctgtaattaagaatgactcctgaaataaaagtactagttgaagaaaaaactataataggccctatctcccctgtctccagcctcaggatgttgtaaaggataagcgtttgttattttgaagatttcaccagtatttctgtcaaaacttgcctgcaatttttgaaacaactgtacaaatacccatgtcagccatacaacatgtactggcagtttaaatgaaatggttttatatcttctcacaatggaaatgcaaaatataccattcaacacaataaggacagaggagagatgtagaggaggagcaatattgtaacagctatttcacaaagaaatggcaccactaaactctaaaatgaaactgtgtgtaccctgaggatttttcacttctgggcactcctatcaagtcccttctgtaagcttctctctctgccctccccttcaaggctgttgttcccctgggtgtcacacatagccctttcatcttctattctacgcattgcccttgagaaatattatacacttatccatgcctttaataattaatttgtaactgatgaccccaaaagctttatcttcagtccattcctatcttctaagcctcctaatcctcataatcagtagcccgttaaatctctctcctggcatatctcacactcatctcaaacagcatgcctaagctcaaactcataatctcctctcccacatatattcctcacatatcccctatctcagggaatggaataactctatgtgtgatttgcaagccagaaaccatggagccatcctaaataactcctggccctaaatctgctcaaacccatatccaattgatcaccaaggctgtttagttctcacacctaaatgtatgttgtattcatccatttgcactttactattcccactgcagctgtcctcattcagaaagtcttaccagctgttttatttaaatacaagccaattaaatgattttattttacattttctaacctgttcaaagaagattattacagagccaaatatacagggttttatggattaaacgagacgatatatgctaatcccagggcctggcatataattgtggcacacaatgccagtggcctagtcactacccatttacccttcctcacttaccacaagaaatccaattttgtgggaagcacccagcaacctaatgaaaaatactcatttctacagacatctttgcatttctgtaattaagatagaagctttttttgaaggaaaactaatatcccatccctcagagcaatagagatgaaaagaaagcaccattcattctttactacagtaataatgcttatcacactatagctttttgctagcaatacttaatatggtctgaagccattagatatctcaataccagtaggaaactctgttaaaccccataatatccttttaaagtaacatcgactctattttgcagacaaaaccacaggtgcttttatatgcttacataatattgtctttagttagcatggattcattccttaggtaacaaaaaaatacaatcatcacctgttctagaagtgcaatataccttctttaaaaaaagtaaatgggttcttaaaaattgacctcatgaaaatctcttacctaattgcccatgagtctttctttctagctctttactctcaaaatttctcttagatacccaagctccttctttaccttaactctcagtttctatgtcttgcacattttattaccatatcatctttcctatctatcccctccttccattcttatttctctggtctgggcagagccaccttctgcttgaaattcctcatgagtctcctgcctcttctctctaatcaagtcccaccactcccaaagcaacttacctaacaatcaatttgctaggtcaacaaccagcactgactctctcaattaaacgaaaacaacttagtctgtttgtcaaggcactccaggatatggcctcctcctgcctttccatccccctcttttaacaactgaggacaagcatcccatatctcaggcaagagggcacttgctcatgctttgccctcatgcctacctgggtacacatacaggagatatgattacttccattccagctatctttctacctaacagccctcaaatcccctcaaatccctttctacttctccctcaaatcccattctggcaatgagtttcttagtttgtttgtgtgtgagtgtgtgttttatttttgttttagtagactttatttttagagtagttttaggttcatggaaaactttaactgagtgtacagagatttcttatatacctcctgcccctacacatatatagtccctccccattatcaacatcccccaccataaaaaaaaaattgttacaaatgatgaacctacactgacatctcattatcaaccagagcccacagtttacattaggattcactgttggtgtacattctatggtttgggcaaatacatagagacatgtatatacaccagtagtttcactgccctaaaaatcacatgtgcttttcctattcatccttctttcacctcatttgttagtttttttttttacaaccctcagagcagcatatattctcaacatgtttcctatttttgattctgttactatttgtatgtgtttcttccatcattactgattcaagttatttaaagttcaaaactgtatcttgtcttctatatattttctgctataagatagatagcatctaagatagcaaatgttaagaatatttattaattggatttttaatgaaaacatacactttaatgggggatatttaaagaaaaccttttataataagccaaagagccattaacaaagtaaataataatttcttatttgtcttgcatatagatctggattttacttattaagggttttcatttttacaacagaatatgttaaaataaataaaataggaaacaaagaggttagaaatatgctcttaggttagatatctaaaaaacaaaagagttgtgtatttgagatgtttttacatatcatatatctacctacttctattcatcctgccccagagaaaaagtatttgtaaaagaacttgcttggactttgaaggcagaccagagttaaaatcctagctccactaactggatgatttggagcaagatatttagctgccataaactttcatttttttctactactcttagagttactctgtgtgaggactacatgcaatagtgtatgcaaagtgtagcatatagaacctgtatgaagagaagccacgacacaaaaatgatagcttcggaattctatcttacactggaatctctgtggtatcctgaataaggtgccagttctccacaaagcctaacgtcaacaatgataggactctttacttatttctccttccttataataaaaccccatcaactgaaggggatggagaaagaaactgttacgtagaaacttcctttctctgaaataccagcaaagcagagaggacactcactggaaaactaatgatctttataattacagcaaaatcataatctaggtaactattttacctttttcactggaaatatatagaataggctaaataaaatattatcactaataagtataatattaactactaataaaataattttcataggccacttattttttatgtagagtgtatcttctccctataggtttctagaagagataaagtggcgttgtaaagattagtccatgatactaaatcaagaagaatttcaaattcagtcatacttttttttctctacccacatgcaaccctttaaggcttgtggtaaggagaactcctccttgttcctaacaagaacttcccactcttcttaaggtttcccagccccagttgcttacgttatcttctctacttgaaacagcctgatgtcagacatttctaacctaaagctttaatgagatttaaataatcgtcatactttactactactaaaggtgcttgtatttacaatattttctctaaatattgaatgaaaaattcttttctcccctctctgtgatgaaataaatatttgtcattgagcagaattgaataaaaatatttatggttaatttcctgacacggtaccagatttacagtcgctcctattttatctacagttgaagtcaaataatgtcataaatctgtcccctcaactcacacttaagattcacttctaaaagaaagaaatagaattcccaaaagataaatgcttttgataacttctcatgaaatatagcacctctttggctgatatacagccatagtgtgctgcttctgtgatctgttactggtttcaaaattagtggtattctgggagactaattaacatcattagccacaatataaaagtttggaccattgcatttagaagaatggcctcttgatatcaattattttataaatatgaaacatgaattgagcatgtttataacaacttatcaacctgcataaataaacaaataaataagcaaataaatacccagctagatttaatttttataacaacaatagtcctcaaaatcatgtcccaaattttatttaaaactgattcaatttttaaaatctaatagcctgatgatttggtacatatgttttgaaaactagcataaggtgccttctcttaaatgctaggtcctcttcccaatcctcttaatactaagattcacactgggaaagatattttgtaaaatatgtgtatttagaaacttcgcaaaaaagtttcattggccaggtttgctacttggtctaatgccttgatgtctcacaaggccaaatttattatccatggagggtgggaaggaaatatattttaaaaatccagacaactcaaacataggcaatttggagtggaaatatgctaactttcttaaaatagtaaacccttgcaaaatgatcctatctgagggaaagtttagcctaagtaatgaataaaacaaagttagactatatttaaaggcatttagatgtcttccaataaactagcaatttatccaatgagaatatgagatgggtgggtggtgcattgttttagctactcatgaaaatggtttattaaattaagctaatgaaatagaaatttaaaacctatgaaagtattaagttgtgtaccaatccaagcaaaagtaaacatgttttgtctatttcccccttctcctgaaactgtatttttttattgtttgttaaccttctgtcaatattaaaaatcttatattgcttcacatactcttgtttgtgggattttacaactacagctgctcacctctcctacttgaaactctcccaaagctttgatttctatgactctacattataataattcctcactcatatttctgtattagcatagactcatttttctcaattcttatctgactcctcttctaccattaacaatgtggacattacacatgactcaattctacccaactcttcttccttctattcactctctccttcagcctctccaacctccacaggtttaactaatatgttaaggtaaatggtcctcaaatcgatcactagctttaacctctactatgaagttaggcattgctaactatgcaggatatatagttacaaataactatatatcctgtatagttagtggcttccaaatttcctgatagaatagtcatctcaccagacttaaatctagactaattaatcttctagtctcaaaataattcacctgatatttttatttctgtttattatagcatagctttttttctttcatccatccactatgcataaaactttagaaatgtccctgactcttctctctgcccagctctggcatttgattacttgcccagctctatatcttccctaatacaatatttttcaaattcagcttttcattttgttccattgtcatcatcctggatgaagttcttatatcattattatgttttctaattttcctgtttctacctgccctagtaaattgcctcctatttatatccactagactttcctattgcttacaaaatgaaatgtaaccactcaaaatcctcttaagtatgtcccaattcggtacctggaattttttcacatacacagtcccaagctaaattaaaaagactctttttcagagtcatcatctttgccatcccccaccccaaaatgacaactgggatttccttttcctaaacccaaactcaacctctacattgccttacattacttcaacagtcaaataaattccagttccttcacagaactccctttcacctgatctctatcccagttggagttgatctcctcttgtcccaaatgcctatcgtaatttctctacatgattttcagcatctgagcacatctactactgaacagtgaatactctgccataatatgatgtcaacaataatttgataaagactgcttaataaacagtctccaaaaatactgttttagcccttattcctagccaaattaaatgccaatcatctttatacttaaattgcctagcaaatagtatatatactgctgatttcccaatgatcaaattccaaattagtatctgcgttaatgattttaaattgcctagcaaatagtatatatactgctgatttcccaatgatcaaattccaaattagtatctgtgttaatgagggtttattatagcattacacaattctagttaaaaataaatacgaccataggtgggatttgaacaatgagaacacatggacacaggaagggaaacatcacactctggggactattgtgggtggggggagaggggacggatagcattgggagatatatctaatgctagatgacgagttagtgggtgcagcgcaccagcatgtcacatgtatacatatgtaactaacctgcacattgtgcacatgtaccctaaaacttaaaagtataataataataaataaataaataaatataatcatttgttcttttggatgatttcaaaattaatcaggtataagcctttatttctcctcaaatggtagaattatgatgcacgtttttaataaactattttaatcttcttgctttagacaacaagaacaaagatatctttcaaggggacttatattgcatcattcaaaatcacttcaaatgaaggccacaagtttcactttgcagaatccaaacatctgttcctccctaaatataacccatgaattatatttctgtaagtctatagcttttattaaaggatacagaccggagcagaactcccagggtattaagaacatctatcctgtagcattctatctttataatgacatgtagattttccatttaaaaaatccttaatttaaattatttagaaataatgtataaaatagctcctggtgtttaaatttagagctcttctagaagtttaatctaaaactactccttaacttctaagtattttcatttgatggaccactgagtggtttttaaattttatttcctgcttctaactcttgacaatttattcctttaaggaaagcaaaaatactgtcagtggtcatgtcgttctcaacaaaaatgtattctagtaccattcactctagtatacaattcagtaaactgaggtctatgttttagctgtttctaaagaaggacaaagagaatactgacatttggttatcttaccgataagatagtcctatgacacatatattgaagacattttattttgaagctcaactgaatgactgtgagttacagacagttttatatttactgatatactttcatctaaccactgtgaaattatgaaaagaaaatagtgattgaattattttctgtctaattacatggctaagttaaagtttattcaagtttggagttttaatttcagatagatttttccctcattgctattgtaatcctcccaccacattgcatattttcaaatcatccagtttatttttcctcttgctgataatataagtcacctccctgtgttttttgttactctacagatgtcaaagaatctttatgctctttattaatacataagatgccaatgccatacatatcatttggattattgttccagtttgcaggtgtgatggacagcacaaaatcaaacacgtaactgtgcccttcagtctttaaaatgttcacgttttatggaagctttggaatgtgttaatgattctgatttctggatataacaatttgtcttactgaatattaaggaggcggcattagggcaataaagtattaaatgttaaataaagtattaactaataaataaaatatttattagctaatagacactttaaagacatggtcttgtttgatactcaaacaaccaaagaggtacacaaccttgtctaagtttgaaaagaggaaaaccgaaatcatctagtttaggacgcttcttaatttcttgtaatcagaaaattatacaaattgattttgaacccaagaccaatttctgtacttgcactctctccaccatattcagataaataatttaggaatttaagaaaagtctttttaaaaatcgtacacttattagagaagcaatgacaatacttccacctattcttatcagtcacctatctgagcaggtggtttacacaactcttttcacaagagaaggggcataggctatgatgctataggtatagctcaatgtctggcctttggtctctatgtcttttgatatagaagccactgagagtttgcctacattcccagaggctcaaagtgatagctcccttgtccttatgcccatatagtagcatgcaacttctaaacagaggagctatgagatcacctatttcaaaagggatttctgaattatttctgccttagcccacaaagatatctcactggtgcattgaccaaagtcagttcagatgctctaaatgcaaaaaaacacttgggaagcaagagtcaaatgtagtaccaaatactctctccaaatagttacattataataatttcaaaaaatatgtacacagcaggtattgttctaagtactgtgagaaatgcatacacaaactatatgcaaatactgccttcaaggagcccctcaaaaatgaagacctaatctgcctaatatgaagaagttaaatatgactaaaagagaatttaagacatgttcgtaaattgcacaccataggtactctgggtttccaaaagagataatcaattggtcaccttttaagtaagttctggtattaaagaaatttaaagacagcatttgctaaggagttccgggggttgcatggcacaaatattaatttgtcaacaaatatgtgctgcttcctgggcttgccactatgcctccaaagagaattagatacagcctaatcctcaagaaaacatgaacaaatcaataatgtcttataaaacagtacaagttctaggttaggctttataaagggcagtcctaaaagacacaaaggagagtgatcaagtcttctgtgtacatgacaacactgcaaacattcattgagcagcaaacatagtgctagtccatgggttgccaggaggaataccaagagaactagaaacaaggtggagataaacggattaaattgcataaaagttaaaaggtctagtggcatatttactttttcagctaatgctttagatgttataatataaaataaatccaaggctatcccaagagtttgctcctaatatattttcaagtctttgctttcccaattaaaatgtaggctcatgatcaaagacagccaagaatgtgatcaaataaaatctcaatttaaaaagtgttaagttctgtttataaatttcataatatctttttccttcaaaatgattttctaaaataatcaacctctacttatttatgttaacaacaaatttttgaagttaaatactactcatttctacatatttagtgtcctacagggataaataagaatgccatttctatctagtatatgttcttttccctaaaacagtatgtttaaagatgttatttgatattatactgcattgaagttttcacccactggcagctgcgtattatctgatggagcagaatgggtgatgtgtcaaggaagaaaatgattctaccaggagcatatgtttccaggtctgtaacaaatatcgagggtgtgtgggcagaccaacatttgctgtggaatattaaagaattaaagactgagtttctttaattttctgagcaattcacaccaatcctacagcatactttaagcagaactgccagtatagtgagaaattttccatcacttacaaacgaattcaatgaatatccactccaattcactacagtgcccacaaagaactcatgtatgtatgtttctgcataggtataacaagaaatgtttttgtcctatcttctttcatcctttccttcataatttagtggtacttattaaatcttttttgcttcaacagaaaatacacatatggatgatatgatgttgctcaatagataacagaatcccattagtaggcagatgttgcacttgctttttttatgtaggccagtaacttagaggaaatttttaaattatttataaatttactaagttctgcaaaaaggttttgtaatttgcacattttggctcactttttaaagatatggcttctaccagagagttaaatcatgagtgaactcccatttacaattgcttcaaagagaataaaatacctaggaatccaacttacaagggatgtgaaggacctctttaaggagaactacaaaccactgctcaatgaaataaaagaggatacaaagaaatggaataacattccatgctcatgggtaggaagaatcaatatcatgaaaatggccatactgcccaaggtaatttatagattcaatgccatccccatcaagctaccaataactttcttcacagaattggaaaaaactactttaaagttcatatggaaccaaaaaagagcctgcatcgccaagtcaatcctaagccaaaagaacaaagccggaggcatcatgctacctgacttcaaactatactacaaggctacaagtaaccaaaacagcatggtactggtaccaaaacagatagatcaatggaacagaacagagccctcagaaataacgccgcatatctacaactatctgatctttgacaaacctgagaaaaacaagcaatggggaaaggattccttatttaataaatggtgctgggaaaactggctagccatatgtagaaagctgaaactggatcccttccttacaccttacacaaaaattaattccagatggattaaagacttaaatgttagacctaaaaccataaaaaccctagaagaaaacctaggcattaccattcaggacataggcatgggcaaggacttcatgtctaaaacaccaaaagcaatggtaatgaaagtcagaattgacaaatgggatctaattaaactaaagagcttctgcatagcaaaagaaactaccatcagagggggaggagccaagatggccgaataggaacagctccagtctacagctcccagcgtgagcgatgaagaagatgggtgatttctgcatttccatctgaggtaacgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgagggacgcacctggaaaatcgggtcactcccacccgaatattgcacttttcagaccggcttaaaaaacggcgcaccacgagactatatcccacacttggctgagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagaccagtggttctcccagcacgcagctagagatctgagaacgggcagactgcctcctcaagtgggtccctgacccctgacccccgagcagcctaactgggaggcaccccccagcaggggcacactgacacctcacacggcagggtattctaacagacctgcagctgagggtcctgtctgttagaaggaaaactaacaaccagaaaggacatctacaccgaaaacccatctgtacatcaacatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagatgatcaaattactctgagctacgggaggacattcaaaccaaaggcaaagaagttgaaaactttgaaaaaaaattagaagaatgtaaaactagaataaccaatacagagaagtgcttaaaggagctgatggagctgaaaaccaaggctcgagaactacgtgaagaatgcagaagcctcaggagccgatgcaatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgggaagagaaactccaagacacataattgtcagattcaccaaagttgaaatgaaggaaaaaatgttaagggcagcagagagaaaggtcgggttaccctcaaaggaaagcccatcagactaacagcggatctctcggcagaaaccctacaagccagaagagagtgggggccaatattcaacattcttaaagaaaagaattttcaacccagaatttcatagccagccaaactaagcttcataagtgaaggagaaataaaatactttatagacaagcaaatgctgagagattttgtcaccagcaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatataaatggactaaattctgcaattaaaaaacacagactggcaagttggataaagagtcaagacccatcagtgtgctgtattcaggaaacccatctcatgtgcagagacacacataggctcaaaataaaagcatggaagaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacatacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacggtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaatcgacaccctaacatcacaattaaaagaactagaaaagcaagagcaaacacattcaaatgctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactagaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatattacaaggctacagtaaccaaaacagcatggtactggtaccaaaacagagatatagatgaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatccctttcttacaccttatacaaaaatcaattcaagatggattaaagatttaaacgttagacctaaaaccataaaaaccctagaagaaaacctagacattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaagagaagacatttatgcagccaaaaaacacatgaaaaaatgctcatcatcactggccatcagagaaatgcaaatcaaaaccactatgaggtatcatctcacaccagttagaatggcaatcattaaaaagtcaggaaacaacaggtgctggagaggatgtggagaaataggaacactttcacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtctattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggagggggagggatagcattgggagatatacctaatgctagatgacacgttagtgggtgcagcgcaccagcatggcacatgtatacatatgtaactaacctgcacaatgtgcacatgtaccctaaaacttaaagtataataataataaaaaaaagaaaaaaaaaaaaagaaactaccatcagagtgaacaagcaacctacaaaatgggagaaaattttcacaacctactcatctgacaaagggctaatatccagaatctacaatgaactcaaacaaatttatgagaaaaaaacaaacaaccccatcaaatagtgggcaaaggacatgaacagacacttctcaaaagaagacatttatgcagccaaaaaacacatgaaaaaatgctcaccatcactggccatcagagaaatgcaaatcaaaaccacactgagataccatctcacactagttagaatggcaatcattaaaaagtcaggaaacaacaggtgctggagaggatgtggagaaataggaacacttttacactgttggtgggactgtaaactagttcaaccattgtggaagtcagtgtggcgattcctcaggcatctagaactagaaataccatttgacccagctaacccattactgggtatatacccaaaggactataaatcatgctgctataaagacacatgcacacgtatgctattgtggcactattcacaatagcaaagacttggaaccaacccaaatgtccaacaatgatagactggattaagaaaatgtggcacatattcaccgtggaatactatgtagccataaaaaatgatgagttcatgtactttgtagggacatggatgaaattggaaatcatcattctcagtaaactatcgcaaggactaaaaaccaaacaccacatgttctcactcataggtgggaattgaacaatgagaacacatggacacaggaaggggcacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaaaaaagatatggcttttacctttgggtaatttaagtgacaggctgtgtatctggtttcttcaacagcttaaaaagcaaacaacaaaaacagaaaacttgtgaagaaataaattctcagactctttttggtaccagagagatacttggaaaaaaaagtaaagactcaagaatggatcttataaatgcatcaaaaatagcaattcttaaaataataattttgttgtgtttgcagattactaactcaaaagtcattatttcaaaacccatatggtgtcacataacagaaaagattaaaagagaaataccaacctatagaatatgtttatgagaattaaactgtgccaaaactcttggcaatttaaaattgatgtaaatgtcttaatttacatttctacctaatctctctaatttctctgaccttttctctcactaatcctcaacctgatcaaggagctttagacaagctagtctatttactcagcttcacacctcctttttaaaatgtcttctgcacaaccgctccctgtaagtacttgtaatactctccccccaagttctcttcttgacattctccatgcccaattgagcttaccaactcctccagcataatcccacggtctctgagccacagtcattgtactctttctgctgaacttgtgtagcctatgaatcttagaatgtgttaaatctaatcccaggacaagtagtggtgcctctagaatatctatttaggtgaaaatgagggggtggcaaaccgggaatataaaaaagtagtttaggaggatttgaagtaaaactgtttccttagccagcatgctgtttttgcttagagtttaaattactagtcaatgaaacatagcaatgtgtcctaaagatatttattcatacttcacataagattacaaaaacatttgtttgggcataaattctcataagctaccccttgatacttctatattaggcaacaaccgtgtcattgttctgttacatataaagaaaggccacaaccacaatatgtacataataaacccaaatgagcattcatagactgaagaaattactctcagacttggtcaggtggcctagtaatacattccctgaatcatgtcttttccttcatatacataaaatattttgtatttttgtatgtatgtggataattgtttttaaaggtttatttctccaactacagtaaatgtaacatggccagggatcacatctatctctacttcccattatattatatcaccattgtctatctaacacagtgtatgcaactacagtgaactccctaaataaattgaataaatgagtggataaataccacagctttaataaataaagacactgcatcatagaatcagtctatatgtgtctgttccttgaatattttattgtttggggcacctcaatatcatgaaaatgcagacaaattggaagatatccagaaaaaatcaggggggtgggaatgattaaggaaatggaaagcctaatgtctaagagaagatttaaaaagtgaaatatctaaaacttggctagattaaagctatgaaaaaacatgacatattccacacatccttgaaggtaaagtgagaacttagtttgatcagtatagtaagaggaagaggaagagccatggaactcaggctgggctcactggtcctacaaacctcacctgctttcaagaaataagccacatagggacacagtaagaatgattgtgggcatactttcaactatcaggagcccctaaagtcacctagtggtttctcatggggtcagagttcaaggattattctctggcctacaatctctctccagagacccatgctggtcctggtgggtagaagctcccagtctcataattgtttgctgcaaaacaaatatccaagggaaatctattagtttcctatactattcattctttgagtaaaaattatatatcagacttaaaaaaaataaaggtatttaagacttacaacccccatcacactgaaaactataattccaagaagttccaagaaaagtaatgagttgaaaaacattttaagtactagtacagtgtcagatgtactataggtttgggaaaatattagcaaaggctgctgacattaacaaatttacagtgaattttaaaacatgcattgaaagaaaatcatgcctaggatcaatctaaatgtctgcaagttataaactcaaacattctagaatactttgaattaaaacttgatgaaatcttacgaataaacacaactaacattagtaaggtgattaagctttatagctctcttgttatgtttcaacttggttgtcaagctactatgacattgtagttcttccgacaatagccatgttcccagttgctaaaaaaacaactcctattcataaagtattttcacagtattaattttcattgcattttctcaccagttctatgagacatataaaaatgtgttgttcattctatgtttacagatgaaaaatctaaaacaattaaaatggtatgtgacttggccaagatcacttgactggttaatggcatctaagatttggaggcagattttctggtagctaacccagggctctttcctatgtaatgtcatgcatcagatttatattgattttgtattttatacctcccaaaatcaaacttttttatgccacaaataatagcacaatttccttatatgcctaagagtagcttaatgaaaaataatctgtatttattatcaaaatagatagctactgatatggtttggctctgtgttcccacccaaatctcatctcaaattgtaatccccgtgtgtggaaggagggattcggtgggaggtgattggatcatgggggcactttcccctctgctgttctcataataggaagttctcacaagatctgatggtttaaaagtgtagcacctcctccctcaatctctctctcctgccaccacataagaagtgtttggcttcctcttcaccttccgccatgattgtaagtttcctgaagcctccctagccatgtggaattgtgagtcaattaaatttcttttcttcataaattacccagtctcaggtagtatctttaaagcagtgtgaaaacggactgatacagtcacacatgcaaaattatatgtttatctctagctccactacagatacatattactgaaaatgcataagattcctatgtgatacattcataatttggatttagatgatagccatttctaaattctgacctttatggatgttaggagataagcaagtgttacattctgtgacaagaacttgacgtaataagcatgatgcttgttttccactttgctattttccaaattaattgctctttcccttaaaacaattttataaaaaaaaaattctgcacttaagccaaaatcgtggtccactagtatcttgttgtcagctctattcatgtttattattgaccaaagcaaattctttggtgttgggggaaaaaccacttaagaacagtactatggcatagttgaaagaagattagaatgaatgtagaagggctgaacttctcatatttagtatacctagatcttaaaatcttgagaaaattcctcctgttctaggtctctatctcattccttatagaaagtgaacccagaaaagttccaatagtttactcaaatctaaaagttttagtttgtagaaattaaccatgtgtcagagcaagaaattgagagagttagagcaactttaaagaaatttaatataaaaaactaacttggggaaggcaaagaagaagagatggagtcaggagtctttgtgagagaaaaattagtaagatatggaattgcctgtacttgaagagaggaagttgaaggagtcaaatataactctcaggtcttatgccagagaagctaggaaatgataatgtgaacattttgagagtagatgtgggggagatcataagttcaattttggagataatgactttaacatgtttcacattcacatggcagaagacagttggaactgtaatattctaaaactcagaagtgatgccaggaccaaggaaacagctttaggaattgtatagatttgagaactgaacctatagaggaacatgagtcctccaaaggggaaactatacatagaaagaagaaaagatccaaaatggtggtcatgagccaagtttgttccaacaggaagatggagcagcaaatgagactgatttgaaaatttctctgagagaaatgtagataaagaacaaacttttagattgatcatgcaaagataggttagcattatgaaagcaatggtaatgaggttgtactgaagaacaaattgcaaacagtgaacaacagtttgtgtggagatacatgatattatagactgtgttaatgaaatggggctgttaacaaatgaaagtcaaagataggaaagtcatagaaaacattttagaataagtgaaatttgattattcttttatttatttagatgagtttatggtgtttcccatccccctctgtaattggaatgaagggaggtgtaaagttgtttcctccttttcaagattaggaaaaacctgattacatttgaaggctgatagtatggaaactcttaataaaaaataaatatgaagagtaaaaatgtggaaaatgtagtcatagatgaagagaaaaaattatacattcaccaaaatggagaaatttgctttcaatcatagatgtaatgtatctgccacacagacagaagaaaaagaaggaaaggcaaatttaggaacaaagtgaaacaaacaaacaaacaaacaaaacccaaaaaactgcatctccaaataacgctttactggagcttttcatttttcttcaataatgaaaaaagttaattgccacattctaaatccaacacatttcatatgttttgcagttaaacaactgaagctaggagagaattttaattccaacttctggccctatgcttctttaaaatattgctaccaaaggagcctataaacatagcagtgcattttccttaagggatgtaggcattttagttcccaagctggaggtcattaagaatcatcctcaattagaaaaatatgatataattttggaccatgcattttttaacaggaataatttcttaaattgtcatgcccctacactattttaatctaacgaagtctcaatttactctgctgtaacatgcaaacatacatttctctaatattcaatctatatccaacataaactttattgctttaggatctgtctactgggaaaaaagtcgtatcttttataggaaatgattaaatccttctttcaatgcatatttttcaaaggacagggccaacacatagactaacataattctaccatgcaataaattacagttaatttatccacaatatcatctaagatcagtttttactaaaaatgtgaagcaaacagcacattttacaaaacagattcaaacaaatattcataaatctcggttactttattatagttactgatacatatgaataacagaaaaaaggaatagccctaaagtacattttatacaatcaaattatttttaatataacaccaagagctttaattccttgaaaagtggcaaaacactaaatgcattattaatcagtaaactcaaataaattcctcagttattttagagaaaacaagtttattttccatatgccttccttaatagccccatcacccttgcctactattctgttatcatcgatgttctgtcctgtgtgtgaaaggcctgttctctccaaactccattacccaaatcccacctgtcattaaggtccagctcaaatgtcatatcccttcactagttctccagaactttccagcttgaagtaattactctgtcctattaaccctaatgtttattaccagcaaatcatgttcagtatgcattagattatctgctattatatattattaaagtactatatatagtactatatatatatagctatagataatcgcttcaccccatccccacactcccactagactgtaagatccttaagagtaagattcatgccttactcttgtttgaatctatttcagcacctaatacatggttacatatagttgcaattcaatacttacattctgagtaaattttgataagtgaggacttatcactttgatgactagcagtcctttgatgattacttgtcagataaaaaaatatgaaggtagaatttagaaaaaagatcaatttcaatagttgtataactatttatagttcactagtaaaatgctatgtaaagtgttccaatataaacaatagttaaatattaagactgtatattttataagtctgacatggttctgttctaagttaccactaatttaaattgagttaggactgtcaaaaatctgttattgttatatttaaggactttatctttacaaagtcactaaatgtaagtttgcagataatagggtttcttctcaattggtttaaagtttataattcacataagatatttacgccaagaaaagtattaaatcctttagttaaaatctgcattttgaaattctttctttcctgaatttcaacaatgtcatggggaaacaggggtggcagagaggaaagaaagagagagaggatgttgtggaatataaattattcaacactgcacctacatgtataaattgatttgactattgcaatgcacttgaccagtcaaaaaacaccatgggaacaatggactactaggcttgtgcctaaagcaaaatgtgaacatgttactaaatcaaatatctactgtgcataaacaaaggctgtcttaattattagcatatttatgcagaaaatactagaaattatattattctcgtacagaattttgttttttaaagttattgttaataataataagcttcaaaagctagaaatgatagtaaaagcttctttaggactcagtgagcttgaacagacagaaggatgttttcagatgccacttgtctacgttaagtacttgctagtatttatagttgtattacaaatgtttattctcaggctatcagtacatatattatcaacccagtttgcaataaaggaactgaattctatcaaaaaattaaaaagtccttagcgaattaagtaaaaaaaaaaaaaaactaaagtagattttgcctgaaaagacttgcttgttgtctgtgtttgaaacagacggttgccatatttaataattcagaaatgcaaatgatgtcataaaaaataagaaaaaaatgttatgcaaaagatccaattttttttaattggagaggcttgtagctttacctatgttctctgagtccttgttaattaattctgccctgagtctttcgctgctaaaaggttgttttatctttttttttaaataaacctttgctttagaatagtctcacgtttacagaaaataatagagttcccatatatctcacacctaatttctctatttttaaatattacatcagttataaataatgaacaaatgtttatacattattattaactgaagtccatactttattcacatgtttgtacttttgatctaatgtccattctctgttccagcatgctgtccagggtaccacattacaatttagttagcatgtctccttagttctgcttcatatgacagttttctcagattatttttcttcttgatcactttcacagtttggggggtactcgtcatatactttgtaaaatgaccttaaaaattaggatttatctggtgtttttctcatgattagactgaggttatgggtattgcagaggaatagcacagaggcaaagactacatcatgtcaagtgtatatactatcaacatgacttatgactgttaattttgatcacttaactgtaatgttagtccagtttctcaaatcattatttgaaagaaattactattgacagcctacaggtaaggaatgcacattaatggcccacttccctgagggtataatagctacacaaattatttgagtccccccacaccatttatttattgattcaatactttttatatcagtatgatctcatggatacttacattatactttgggtttataactcaatcctagtttattattcagttgttcaatttgttccatctttggccactagaagctctttagattatcttttcaaattccacccaagcatccctactcattagtggcttttttgagtaatacaattctttgcttatatcagtatcacaagtaggggttagaggtgataaagaaatgtatttgtcttcaaataaagttttctatagctacaattaactgataagacattttaaaatagaccccttaatcaaaggtcacaaaattgaccatatgctctctaccaaaagaaaggcacagcagaatcattctagtactaacttatttcatgaatcatgatttcaagtatgaaattctaatactaatttatttcatgaaacgtgatttcaagtatgaaattatgtgcccctaaataatttcccattgttaattacgtatgttaagtgaaatctcttgtgtaatgtttaaggcaaaataaatttttctctttgacaaaagaccataccaaggcattaagtgaaaaccttttagttattatactcagctttccatgggatagttatgttttaaaagttaatattaaaatgctagttttcattggcttttagttgatatatatgtatatatatagatatatagatatatcacatatatgccttaagttgctttctatgaattatataaattagctctttgggataaataactataatcctaaactttctctagttaaaacttaataatttaaaacaattttatgaggagaacttagaagtctatattttaagtgccacagaactctctgagaaggcagctatcaaaatcactaaataaaaggataatgaataaaaagaggaaaacattcattctaggaatcttctgtgattgatcttatacagatcttctatctacatatacacagtatttgtttataattttatgttaagcttatgttatgaactctaacaaagttttgcaagaatgaaagagaatatttattttgttaattacacaagtattaatataatgccatttattagatacaacttaagaaaatttgtgtcctcttctacaacttacacttaatttaatatcaactgtatttttagtcattatagataaattgaaagccaatgttatcagttgacaagatttttcaatgtcacacatgctgaatgttttattaatacattttagagtacaataaacaatatttgtggaatttaaaataagaaagtatagaataaatgcattttcaataagatatgcatgggctgggtgtagtggctcactcgtgtaatcctaacactttggaaggctaaggtaggaggattgctggaaggaaaccaggagttctaggccagcctggccaacataacaagacaatatctctataaaaaattttaactatttaaaataaaaataataagatatgcatgcatatataagtacttactatatgttgtatgtaggtggcacataacttcaggattcccaactattgctacttagaaaatatatataagtggcaatatggtttcccagaaaatatgacttgatgaccctgatggaaccagtgttctcactactactctgaattttatcacatatatcctgcaagaagcatactgtcacatacctacagataatgtgtagaacccatcttatatcgagtctgatagtagcttggcccccaattcagatgtggcatgagatcaacttttgtcccttaagatatcctaggccagccaagtcctttctctcattctgtctgctagtcacattttatctattacccatacaaacctttgttggctgttccttccctaaacacactggatctcataatgggaattatccagaacactcattctctagccccactgagtcactagtgatccttgattcaaacacatccaaaagccaaaacccaaatgtggtttgagcctatcatctaaattctctctatacacacaggcatgctgaactagtagagaaaaaaatcacacaattatgccaaagatagcaagacaaatttatgttcttcaacatctgccccattttttcaaactggacagtaccttttgaccattccctggaccattccaaagtattaaatcacctttagcttcacaaagagccaagtaaagctaatatgatttcaaggccatctctatagctcccatcacccacttgcatccaagcagtttgttcatttccttccattgtgaacaattatgttataccattagacataaaaacttaaagtataaaagttcaataaagtcatttcagtgtgaatatacttcaatctaaatagcatgaataaatggttgatgtcaggtccttttctgttttaatataagataagctcaagagtgaaaagagaaatgctgtaagaaaaggttggtgagcaaaccaaggattatcacacttcacaacttttccaagactcagtcctgttggtcattgattagatcaagacaaatatggaactgtccattgcagttgtgtgcatgcatccctgcttcacatgatttataaaggatgtgagtgcatgtatgtgtatgtatatttttatatggttgaacttcatataaacaagctttattctcatatttatttttgagatatcactttacttcaaattttcacatatactttgtcacttaagcttttccagtatgacctgctttttcatcatgaatattgcctatgacatcttcaggaaatcaaccatattgtaatatgtgtcttataagtacataaagaatatagacataacttgcactagacaaatacacacatatatgcataagcaaatctatatacaccttatatttttattggtcaatcagatacattagagatcatattaagtaaagtatatccataattatactattaaaatattttttatttgtatttctgtacaagaaaatcaggagaaaaatttttaacatgttcagagcaagatatgtttggagcatgtcttggaacaagacacttaggccattcagataaatgataatggaaggaaactaaatcaaaaggaggtagaagacataaatgctctggaaggaatctgaaataaaatacaggaaagaatagaaggtctaaaataaccagagaatatttgcagtctcaagataatgagatatgaattataaataagttctaagagaatgcaaagtaaaggaatggtcatttacatgttgaaagatttgtgggaaatcttaaccttgaatggaaatatattcaaatacaatcataacagaggaaaaatgggcaaaggttgtgatgacacattatagaagaaatggacatgcagtattatccttgagaggtagttaattattacctaccatctgtcgatcagctatcatctagccatcaatctgtctatctactagcaatccatatatcatataatccaactaatactggtgggaaatgattcaaaatttttttcagcagttgcttcattataactttaacttgccaagtattcagttctgtcttcacagatgcctgaaacatgtggctaattcctatttgtctttgaattctaagttcaactcccacatcttcatggaggctttcctaaccccttggattagatgaaacccctagctctaccctgccacatattaccctgtagtcttcctttgttatcagtgataacctctcattacttcttttctgcatgtcttcctcacaagattggaagttcacaaaaaaatagagtgatatctgacttcttcactgctctactctggttgagcagtggctggcacatactaggtgatcaagaacctgtattgaagcaaattgcctatctgtagagccttgtctaaaggtgaaaactaaatgcaaaagggctggagccttgggggaaatttgagaagcagtgtgcagacatgtaggaaaacaatccaaagagaaaagaaacagagacctccaaaaggggtattaagtgccactaaggggttaaattaaataaattctaggaagtgtgtgttatatttaaaaagaaggaggttaaatgacatttactgtttacttatttggcttgtttaatttcattttgttgttctgttttgtttatttcttcaaggtaggaatgaaagggttacagaaatggtaatacaggattaaagagtaatgacaagcaagagagagaaagagagcgagtaaatctaagttcccctttcttaaagtctgggaaggtcaaacgtcaaccacagaagtagcaaacataactgagagccaagggtttgttttaatttacattaaaatgttttgagcatgtttcttatagagaaagaatttacatttaaatttactcaagttaggaggataaatgaaatgtatttttaaattatccattattacagcatagtctgatcttgaagactggtgatacctacctcatctttccaaagattaaacacatacacacacacatacacacacacacacacacacacacatacacacacacactataacgttaaacagaaaagttttagtagcattttcccaaattctccagtacatctgtttctttctaattctgtttggggttcggcttcctcggattatttacatagctctacagtccaaataagtgatggctacttatgaaataattattttggatgcagtgattcccttaggtgaaatatcctgctatcagaccacaagaaaccagaaggaacagtctcagaggtacaacggtaccatagttaatggaggaatttcttgggcatctgccatctgaaaccgtatgcattgtttcttgcttttctcagttgccttttctttagcagactcaaagtctaataacaactctcctaaattttaccaagcaattgtaatccattattattataataaactccaatttataagctaatacataacatttatatagtggtagattgcaacctaatgacaaacactgacctttttgtataataactgcgtctctcctcaatatttgtggctaaagttttagagcctccttctattttcatgtgcctcccaatgacttcatcgtgagtacagctcttctttgctattttcatttaaatagtctgttcattttggtacttaagcaccaccattcaaaaggatacagaaacacataatgaaaggaaattaaaagtatttctaggaagaatgttttcattggttcttgtagttttctggagtattaaacttaagtacagtctaaagaagttttgtttcttttttacatgtcttcctgaataagaacatttctattttcaagatttgcccttaactctttactgtcaaatatttaacattttgcaaaaacaaatgagcatctgaagtagttaggttttaacacataggatctaatccaacatgatgaactacaaatgaagctcccagaaaattgtagccaatctttgactaaaaaggcaccatttcccactggagaatatcacctaaataactagaattcatatacccagaacaaaaaatatgtataattcctaaaagtgtataaatttaaaagtctgagaaaatgactaagtcattggatcagcatatgactgaatacctctgggacaaagcatagtggttaagatattgggctctgagccaggtctctgtgttcaaatgttagtttctccatttataagctatcattataactgcctaacttttccatagttcagttttctaagctgaaataggaaacaaacagtacctgtcatagggttgctctaaggactcagtgaggtaacagaaataaagacacctggactagcacctggcacctagttagaacttagcagctaatactgcatttggaacactttttgtagaatatctcactgactgtgttgcctttcccgtgtgaccagttaaaacaacatttcagcaggaaatcgtcccccagctaaataaatgtaaaaataactatgatggagaatgcttaaaatctctacttattttgggtatttaaaacaacatagaagcatgcatttcaataaaaatgacagtatttctagtcacacagcgtattttgtgaacattctaactcaggtgaagtcatggaaccatctcaagtctagttattgattatgaaagaatttaaatatgtgagtgttggactggctttaattgataaaaaattgtactttcaatacaaaaagtagatatttaaaaaatcacatttaataaaattgtttcttgggagaaatgctattttcaaatgtcactagcttctaaatattgccttacatggctgtatttcgtaaatgtctatagcaatgggcctgttgttgctgtgacactgatttaagaacacattttggtcattactatctcttgctgtttgcctgcagtgagctctcataattagggctgaatacactgcactattaaaattaaaccaagcctctgggaaagaatcatggaactagatggttaaaggacacccaggcaattaacaagcatgataaagttaaaaattgaaaataggaaagtaggttaagagcttttctctctctttccaacatgatttgttgatacagaaggaatatatatcagttttattttacataggaaagaaatgtaaaagcagtgccacattgcagtcaactaaattattttgctgttttccagtggatttttctctttgtacacttagaagacgtgcaattctaaaataattctacatttgactgactttcaaaacaagcctgaaaatgctttacgctttctggaatcacaacagtgtaacaatgaacaagtaaagaattgctattttataaaatttatactaaaaaagtattgattatttatgatttgaatttattaggcttcctcaattccattacataatacctcctttctatttgaactacatgaaccaaataataaaaagatttgcatcccaaaatgttggtagccatgaaagttttcactcttcagaaaagagggaaaatccattcaaatccaataaaaagagttaagattctgatccttctgagactatgtctgggatattttccctgcataaagttgcattaagtttttttgcctcagtattattagagttttgttggaaatacaaataagatctgtgagtaaaacagaaagataaataataatattgtactgtcctttaattatagccttgatctttccttttcaaaattaagacctcttcctttttccccttcctttttattgtgaggctcattaattaaatagggttggtaaaattatgcttttctaattatattatctcttcatgtattaggtgaaggtaggtaatcattttttacatcattatgaactcaaatttaaacatctgatgggtttgaaatcatagaaattcttaccctttttgaagcttatctttggcttcttcaagtgggatcctgattctttttgctattaccctggtagtctttgataacctccttaatatctggtatgtcaagtttttccaggctcttcagatacattgcctgcccaagaactgggatcacacatttctcctcttcaaattaaggcagaccaattgtgcaaattccatcccagtttcagctgctgttccatcccattcctgttggctgcgtgggagtctcccatattctcagctttgtcagacacccttgcttaccactgcttccttcctccaacacatagcgcaaaatcaggtcttgcagttgttgaaggtttgtgtcacttatttttcaggttgctggggatagttttcctgtaaagttgcccatgattttttgtttgtttgtttgtttggattttgatcttgctctgtcttttatatgcaaaaactaagctgacatcttagttttgcatcttttcagactcaagttctttttgcttttgaaaatcatgtcaacttcaatttcctttactaagatctatgatatattttctatttacacaagggctaatttaacactgctcactcaggacgtttttcactggaatattatttcttcactgtaaatttggtaaacacgataaaaaaaaaatcctggtcaccaaaaagttaaaatttaaaaaaatcctttttcaaaatattgactcaatattttattaattaagccaagaggaacataatgttacctttccatccctgtacaataaggttttaaaggtgcactgttaaatcaaatagcacaatttggcaaagtggaacagaaaataaatgatacatacctaaaagtaatgtaattatttctaaatgtcattgcccaaagggatacattctcaactttattttgattaagacagcactgattctaaaggcaatgacatttaaatagtttttatagggctgtgaaagaagggccatgccaaatacaatagatagaatgtttatgtctccctaaaattcatgtgttgaagtcctaacccacatgatagtggtgttgggaggaggggcctttgggaggtgattaggtcatgaggatagagccttcatgaatgggtttggtgccctcctaaaagagatccctcaccccttctaccctgctaggttatagtgaaaagacagccatttgtgacaagcagactcacaccagatagcaaatcaaccagcaccttgatcttgcactttccagcctacagaaccatcagaaataaatttctgttgtttataatccacacagtctatggtattttcttatagcagctcaaaagaactaagacaacaagatatcatatatatatatatacatatatatatatatatacacatatatatatcccaattttaaaaactacataaaaccaagcattatagtaaatagagctcatagaaatatgcatttatttaattgtaatggcttcaactcttatttccaaatgtatgtttctgtgaaggaataaaatgcagattaaatgtccacactaaattattgttttttatagggcacatagggaaaaaggttgttggaaattatatataaaaaccaaagttaagcataatattgctaaaagtctctttattttttcaaatttattaagtgcctactttatactctgcttacttctagctttgggagcctgggagtgcagtaattcaaacagtaaaaaaacaaacaaacaaaaaaaagcacctcatcttagtgggccttaaattccagatggagggggtgataaacaatactcgaagtaaagaaacgaaacattaagtatgataaattgtgtaaattgtgacatgttctatgaaaaaaaaggcagagatatgagaaatagatgataacctggagtttaaaatatgttgaaattttaatgagattatatttgtttataattttgtgctattatgaaaaataccacaggaatcatctttgttctcatgtctttgcaatcttgtcatattttttctttacaataacttactaccctatacattttcaatatttgtaaaatataaagtatcaagctgacctttagaaaggttagaataatttacagtctttagtgtcatatggtggcaagctccccctccatagctttattattaaataattcactaatatttttctaggatttctgatttcagttatttttaccatttataaattaatttttttatttttttttaccatttataaatttaaacctaactttggatttaactttgctgaaaaataataaaaatggattttactcaattatttcagtaaatcatttttctaattccaaattagggtatatagcttatgtttttagtttttttagtcagtgattttcttttcttttatagattccaatcattgttgatatataggaaagttactgatatatcttaatgtatttatcttagaagcagccatcttactgaacttagcagttaactccataatttatctgttggttcaatcaactctttaatgttcacaaaaaataatttaggttcctttcacccaagtatatttctagttagaattgtgtgccttattgtattgcctgacctatccagaacaagtctctcttcaattcctgctcaccaggtagctagcctcaaaactaaaccagttgtttatagagaattctctccctctcaaggaaactccttctagccagttaaatatatatatatatacacacacacacacatatgttttgtcttttttttttttgatacagggtttcactttgtcatttagcctggatggagtgcagtggtgtcatcttggctcactgaagcctcaacctgctgggatcaagtgatcttcccaccccagcctcccaagttgctgggactacaggcatgcatctccatgcctgcctaatttttgtatattttgtagagacggggtctcgccatgttgcccaggctggtctgaaactcctgagctcaagagagctgcccgcctcagcctcccaaagtgctaggattacaggcatgagccaccgtgcctggtcccgcttcagctataattcttaagtagcttgcccaagcaaaagtctctatctttgaatcgtccatacactgtttttagtgtctctatttcttcatgacaatattagatagttcaggaagtcttaatttgggttccaaaaataaatgtgcttcaaggaaactacaaatctttgaaattacaggcaaaatattgtaaataaatgcatgggtcagagggtcaatagctttaatgtgatttgtgaagtattttatgagtcttcaagcctagaatcactaacacaaatggctaatcatgaatgattagtataatcagtaattatagccaatagaattatgggattatttatattgtgcaatacttattcaaccataacttggtgcttctagcatgtatttctgctttttatacattagatatatatccagatcacagaaaatacaggtgtccaaacttttcattctaattcacttacatggatattcagggtaaatatcaaatttattgtttagaaaaagagacaacttttaaaaaatactatttaaacaaagaatgactattctataggaaaaataaggaacagttgttctccctttaaaaactaatcaaataggccaggcacggtggctcacgcctgtaaacccagcactttggtaggccaaggtgggtggattgcttgaggtcaggagctcaagaccagcctgaccaacatggtaaaaccccatctctactgaaaatacaaaaactagctaggtgtggttggtgcatgcctgtaattccagttactctggaagctgaggaaagagaattgcttgaacccaggaggcggaggttgcagtgagccgtgatcatgccactgcactccaccctgtgtaacaaagcaagactctgtctcaaaaaacaaataaacaaaaaactaatcaagtaactttctatattcattttttcagtctctgctcatgttcctcaaacaacctaggtagtgtaaattttaataaggtgcattgtctttttaataaaataaggctaaaacattctgcaagggtataagtgacaactgctctagaaatgatatcacaaagatttcttttaattctgtcaaatttatagatttctcaaattcttttacgttcctaactagaaataattatatttctaaataacaatttttagactgttaaacatgacaataaaaaagaaaaggaaagatttatcaggttataactcatcttatttgcctcatatgtaatacttaactgatttgaaataacatcccaaatggtttaactatgccattttctgatgaaaagaaagatgaacagaaagtagcacatgcaacccaatgaatgccattataattttccctaaaagctatttccaaatgttcaatacggtagcattctataccaactaaagagattaaactggaaaattttgcagaaacaggatatattaaaagttttccgtccggaagcagtgtctcatgcctgtaacgtcagcactttaggaggccgagccgggcggatcacccaaggtcaggaatttgagatcagcctgaccaacatggagaaacccatctctaacaaaaatacaaaattagctgggcgtggtggcacatgcctgtaatcccagctacttgggaggctgaggcaggagaatcgcttaaacacaggaggcagaggttgcggtgagccaacatcgtgccattgcactccagcctgggcaaaaagaacgaaactccatctcaaaaaaaaaaaaaagttttccagtgctaactgcctcatgactagaccaatttcacacagcatatataaaatatggcattgcacatcagggcttctgctgccagggattgcatgaaggtaaaaaggaaatagcagcacaccatttacatggccattccttcatatatttttttcttcagaaattatggaaacggttagagtatgtacttagagaatatttaatttttcaaacaactaacatgccttaattctgttttaattttacactcatacaaataactaactcttaaatagcattaaatgcagagcataacttctaagcactacatatatagaaatgtttatatagcatatacagtatatatacacactatatatactatataccccatgaattttacatatatatatatttttttctattataattgagaaaattaaggtccagttactaaggtggtgaagctcagattctgacccaaacagttcctaatattgttacctcaaaataatatatgcccagtcttttttttttttaagcaaaacagcatcaaggattataaggagaacatataagcctctcccttttccttttaccctacatatcactttccaaattcaaccaccataattgtttcttttagtgtttagttcatatttcaaagacaaattaatttatcaattttaaatactattcattagctgccaactgtggaacacaaggacttagctttctgacatcacccaaaccacatttacgtttctcctgccctcccaccaacctagaataattgcaccacaatctttatttaaaacagtcaacttgtttacattattatgaccaaataaccattaggtactgttgaaccaagcaaggaactgtgattcttttcccttttttagacacctttagatcattctggagttaataaagttcttttgtttatttacttgtctccaatgtactctacaaaatatgaaagtcatcaatatattgttccaaatgatctctggaacacctagtaacattatttatcaaatgctgatatccatctatttgtttttcctaccctgaaggccttcctccagaacgctttgctttaccgccccagtctggactggtttctttcaaggctagctattttggagtactcctgggacttcaggtttctctgtgttagagcccatttcctagcttctatgtcttcatgttgtttggtgtaatttcttgttttgcaggaacatgtcatctaataactttctaagaaagggtacatgggtagttaatactagagttcttaatttctgaatatctttatttaaattttgtattatggcaaggtatggatttcttatggagattactttctctcagaattttgcagactttgttacatcgtcatttaccttaaagtattattcccacttcttgatatgtaactttttctttgaaaagtcttagtcatttgtttgtttgttgcttattcaatggtgttgtaaagcttctgtgtaatgatccttggacagtctttttctttcatgatgctaagtattccataagttcctcagaacagacatttcagttgctgctatctggaaaattttatcaaaaatgtctctattaattccatatgtccattttcacttttttatcattctagaataccttatggtagattttgaccttataaattagttattggttttgctatattttcttatatttcctattcccttttgtctttttgttctaattctaacgggcttcctagactttatctgctaacacatttcatccaagagctgttttttaaatttcttactatttttttcatagcaacgtgttcttattgtgcagataaaatatttatgaagatatcatttgtggagtattttttataatactgtcatttctccttatgccatccctctggaccttctttggctgtttgatttagtctttctctgcttgatttagtcttccctcatgagacttttctcaaatgtctggttatcttttgctttcagttccatattaaccaatgccataccaaaaatataatcacagcctcaatgtacacatgcgggaatttttgcagagtgattaggcaataaacatgattttttatctgaagactttgaaatgtctccctttggaggtattttctccagtttcccgactgagaaaaattggcctggctccaagcatcctaatgtgagcacagggagttctgtattcactaaggaaacccttatttaattctgttttcagtctggctttcctggaactatttcataactggcatttccaagtcctgaattcttctggatttcaatgggtgaaggattgtggaagtggaataatttgtccattaacttcctattttacaaatgttcttgagatctatattctctgatgtctcctctttcttctacttaccaatgtgtctgtgctttttcatattattttggagtgacttcaagagggaggaagtataaatgattaggttcaatccatcacgtttcccagaaggtttggagaattatttatactggcagccttgtttcttattatgtaaaagagttgaagtgacaaaattaatattcacaagaactgaattcctggcccagttcttactatctatctatgtcaccatgttcacgctacataacttctctgcagtttcatttattcatctgtgtattgggcagggaaatgtaatagttggggcacatacttgcaggtgccagtgggaaggagatgccaggtattactgtaggaaaaaataagagctttcattgctttcatctgaatttattaactctaagattaaatgttctcatgacctgcttggagaataattctttgtccattcagtcaataaatatttattacaggtctgttatgatgacctagaaatttcactccaaagagaaatgaaaacatctctgtgcaaaaacttgtacgagaatattcatatcagcagtatttacaataaccaaaaagcagaaacaactcagatgtccatcaactgataaatgaataaattaaaggtagtatatccataaaatggaatgttattcagcaaggaaatgaataaagtactgacacaggtaacagcatgaatgaaccttgaaaaaacattatgctaagtgaaagaagccaataaaaaatactatatattgcatgacttcactgatataaaatattcagaataagcaaaaatctacagagacagagagaggattagtggttgcttaaggctgagcgggagggcgggagaggagagaaagtgagtgctaatgcatatggggtttctccttaggatgacaaaatattctaaaattgattgtggtgatggctgcataactgtgaacttactagaaaatattgaattgcttactttaaatgggtgaattgtatggtatatgaattttgtctcaaaaaagctgttaaaaataaaccatatctgtatgtaataattaggtgatgggatgatctgtgcagcaaactaccatggcacatgtttacctatttaacaaacctgcacatcccacacatttacccctgaagttaaaataaaagttgaagaaaaaaaaatgaagcctctaagaaagtttggcaagaaaagtctattatgtgcatttttacaacattgggaatgtaaaactgagtaagattcataaggtagcatggtttaaattccagggaaaggacacatataaaaataattataaattctgctgaacagaaagcctagatagaaaaataagtgtgtgcacaatgattaaatggaaatctaaaagatgagtagaaactagttatgtggagtgataaaaagtgaaaagagtatttcaagcttgggggtaatgtcacattaaaatcttagttgcaggagagaactcaggttgttctaggagctaaaaatttacccaagtggctggaacacagagctggaatgagtggcatgtaatgaggctgcatatatcggctgaaattatgcagggtcttgaagctcatagaaagtttgtccaatgtagtctaacagtaatgggaagttactaaaggttttaaagagcataacaatattattagatttgctttttaaagatcactcttgtcactctatgttgaatgaaatggaggacaggttacattttctgtcctaaaacagcctgtaaatatcataacaggaatgtcaaccttggagaacctacgttattcgtgtcattttaagaaatctgtaaactggaggcagtattaattggtcaaatcaatatgtatagaatctctagaatgttcataggcagtcattccattccctgaactttagccaaaacaatgaagagtaaggtgcgaagatgtttgttgcagcactttttaaaaaatactgaataactgtatacaacaaagctgatagtctaaaatttataaatatttactaactttgtatgtatgtaaaattagccttatgtttttagagttacagctagtgacctgaaaataaaattaggtttatataaataaaattataagttgtaaatttaaagcatgagtaatgttgcttccttgctttaactgcgtggtcaactattagacaaaatagaaaaatactatgagaaaactaactaacataacttgaaagagtcatgaaatcaatcttatcaaagttgggtgaaatgtgtcagataaacactcaactcaaaaataatcaacttctatatatattctttacttctatatatattcttctacaaagtcccttgaatagtttctgtagcacatatatacaaatagaattaacagagccatgaaggtttattttgcaaaaacataaaattccaggatgcaccaggaatcctgatttttttttcctgtaaaactaatggtaagttgtacatccagatgccttcacaaagaaaattatttttagaagaaaagtacttagagaaaatataattttcatagtgcatgcagacttttttctttattatcactatttctacaactaaaatatatagtgtcagcctaattcatagtttgttactcctttacacaaaatgataaaatgaaaatttgtcacagaccctgcaaatgctcagtactcttcatgtagtgctaatgatctgcaataatttgcactgtacttacaagagactctatttgaaagttcttttccggagcccaattgttgtttctaaataatgaagtgaattatctgctaaacacaagaattatattcagaatgataagattatcacctgaaaatcatactaaatgcattctgctggtttcctgctcactataggacataggtgcattgagtataataatgcagaattacaaatactatttatcttgctttgtggtggtgatgttgttttggtttgtggtttttgatcaagcagatatagttgaatataattttcttaaatgaacctatgatacaaataataagtaatatatctttccagtgcatttaaatttctttcattattcaacaggcacgttcataaacccaagtccacataattaaatatgattagtaaagtgtacctctttactgattctcaatttataatcataccccgaaggaggtttaaagggaaagttgctcagaaaaaaatgaaaactatcttataatattttaatagtataaatcataatatctactaaatgcaacagtgaaacatttgctaaaatttaaagttgcataacttacatgtatactaagaaaaagtaactaaataaattcacacgtttaaatctttgaagaaatttcatgttgtgtctaacagttgctagagccactaagaaaaatgtaattgaacttaaagcacaaaaaggttcacctaacatagaaaaaaaataaattcttatggttaattttggctatgttgatatgaaaagcaaataaaataagcattgctggcagatacagagtgtgttcagcacaaagataacataacagtaggctaattcgtctttaaaccctagaaggttgaattgttttcttgtgagaagctcctggaagcaaatgttctctctattatgaactgtataatatgggtgaagcctcccttccctaatgaacacatcagtgatctctgatatcagtacagttgtggctgcaattcaaagcagagatggaagaacggatgtgacggtatcttcaggaagtaactcccatctctagagtccttgagtacttacaacaaaataagcttttcacacactcatactaatgatgaaaagaaattgaaaaaaataagaagtcaagatacaaaactgcctccgttatgaggagcaagatgttggctggcaatacatatggaaaggagcattctttttaaaagtccctttgtgtaagcatgatggaacaaaataatgacagaatccctaaaatggcaaatagtctggtgataaattcttccaagataaattgcttgcataataaaaatcatccacaaaagtattctaaatattctttcaacctatttaaatgattatatcataactatcaattggctatggaagcacaatgcttgccaagcatcacttttaaaccttagtaaaattctagctaattaatataaaatcaccatgaatttttaaaaatcatatttaacctccaaattaaatgtgtctatgtgttgttcacatgaaattcaataagactaagaccatactgtcactacagaaaaatcgagctacatttgtttttaagtaactatccctattttccctagtttgggtgcttatataccacagcataaacaaaaacatgagcttgttgtgtttactaaattctgtagcttccacccagttatttcaaacagtacctatactattggactgctttttactctctgaaggtttctattgtcatcctctgctgaggaaaaaggtaaatacagcaactctgccctacttacgccaggggtagagaaaactacctgccagacacagcaatagcactcttgggctctggtggggaaaagaggcactagctagctctctgaaagtctcagtgggagcacagccttgtcccttgaggtaagtaaagtagaaagctatcagtcttaaaaattatcgtgagcagggaaactagaaacagtgttaaagtcacgacatgccctggagtaagaacatagtaaacttctctggccatgtaaaggtttattaaaagtgtcaaggaaaagaatcctctggatatcttcatttgtaataactccccactcttcatagaaattactcttaagtgtcattcactcagttgttaaatgattaatgaacttaagtttgacattttaggaattgtagtaaagcacctccctgaaataatccttcaggaaagggcctaaagtaaaggctagatcatgaccgcaaaaatttctagtatctgttgaaaattactcacacattcctttccctgtagaaaaaaactaccgctagaattttgtctttcctatttttgttctttcattacattatcttgacgttatagattttagaaaatcttatattggttttgagatcatacaaaaaaatgaaacaataagatgtaaatatattctgaatgtaaacaagtacatgattatttttgcagtttgttttagaacaccagtgtatattgtaattatgttttaaaatctattttttcagatatctttcagtttaaaaagatctaaataatgataattgcttaatttgtgcctgccattttcttttttccatttatacaagggaaaagtcaaatattccaaactactccacactggaatttagagtattagctcagtttttaatcatttcccatttctttgaaatggataataaaattaaatcatcacctgatttcaatttgttcctttgttcagtaacaatgtttttattaaagagatattttgtctcagaagatttccttgggaaaataaggagaatcctgtaattccattcattcaaaagactttcgcatgctattctaattcctgaaaagtggccctatgtttttatttagcaagtgggaaaaagtttaattacttgatgtgtggtatcattttgataagggatagtccttttcacattgctgaaaaaataaaagcatcatatgtaatcattttattgagtgaaattaaatgttaaaagttcagcatttttgcatgttaatattgaacctggtacatttctggaaataccacatttatttttgctattaagactggagacttttttcatgtaagttattttcatttaaaaattttaaaatgaggtgaaatatatttccattggggactgaggaaaagataatattctatacttgattcccacctttaaaattctaaagaacatgacaaccttatacatcttagaacagggtcatttataagtttgcttccctatcttcctactggaggaaacaggtttgattatttattacatctttttaatatgaacattttcttttttttaaaatttttaatgaacgttctttcaatcaaactcttaatgttctctagactataaacgtcattaggttttataagttctcctttggactttgctgtgtgtttttacaaataagtaccttaaaattatacactttctaaaatccattcactctttgcatagatcacggaggctactgatttctgagacgataaatatctcaaagaaggcaaagaccgtcactctgagcctttgtgtggcgggactgtggatttttcacagctaatgtcattcagaactgtggacagctcccgttaaggcatgtagttggtgacaatttcccttagtttctaaactaactccaaggctgctttacattgctatatttatcctataaagaatacttagtatatgcacatactcctttagttgattcttcttttcttttcgaacgagttcggccaaataaataaatatcaccctgagttattaggagttactagttctggattttaaaatgggaagtccagccttgttcaggagctaagataatcgtgcacacgctaataagaggatctactacacgaccttcatttgacaatctctaaatatgcttatcaccgaacgaatacttgagcgacaagtaagatcagaaaacgtcttaattttaattctccaaagcggagttttcctgctgacagctttcctgtccttcttcccgagctggaggacgtgaaaaagatttttgaaatagacttgcagtcaaggtcaagaaagggtgccgctctatttcagaaaggggctctgtcaacgccccctctctctgtttcaggaactagaggcttcctgccacgctcctgccctgcctggaagcgcctggctttggtgagacctcacgtcagggactatccaagtgcaaattgcccttcttttgcctgccggccgctgtttctgagtaaacacagcgaggataaccagcgcctataaagaaaaacagactaaacacactccccaggggcgagcgcggcaggaactgctcgggcttgtgaatcgctgtctccggttacccagtcttcttctgagccccagaagcctccttttccctcctggttgagaccacacttgagggagccgcgcgaggaagggtggcttcccgcttcctcacgctctcgtctctgaagtaaaagtttcccttgtacaacttcgcctcctcccaggagggtgaccgtggcctccatccttccctgatctgtccccgaagttcaggaggccaaggaggagagcccgtccgggattcccgggcaacaggagcacatcctccgagcccctcctgggtggaaactacccggaggcgccgagtggagcctgcttagcccgagccgacgccgccggcagcgccaccccccgcccgccctcctagtccccgggacgccccccacccaagggcggggaagcgcgtttcagggcgcgcctgaagggagggtggggcggcgaccgggagccctcacctgaaatcactgtaagggtggataatccagaagcctgcagttttaaccctttcctgctccttttccaccgccttctggctcccaaacatgcggagggagaatttgttgaccccgggctgcagcatggaggtgaactgcctctgcatgaagccgtactgccgccggggcccctcggcgtcttcgaagccccccgccggctcctcgccgccgccgccgccgccgccaccgccgccaccgccgtccaccttgaagcacacggagttgccgtgctccttcgcgccggccccgccgccccccggcggggtgcccaggcgcttctcggccgcggccggccccgcgcccgtcgcggacgccttggcggggaagacgctgttgccatcgtcccggctgttagacgaagagttgggcttgccgcctccttccatgcccggaggacgcggccggcgacgg

SEQ ID NO: 222 - DNA, 45204 bp, Homo sapiens
ttataaaagcttgtttttctttattagaatacttttttcaattctgatttgtcacaatttagattctttttctaagaataagcagaaatttacaaaatttaatttttatttatacattcatccgttcaatacacatttcaagaaagctgtattgcaccctttcagtggtagttacaggacaaagaaacaaaataatccaagagagagaccaacaaatgtatatttataacacagagtaataaacacaaataaatgtggagttatttaagcatgtaagatggtacatgctctaccaggtatgggggcttctctaagacacaagatcagattaaagtcttgaaagataatctggggttagtcaagcaggtagaagtgtgaagagcactttctgagcggaatctccatgtgccaagtctagttcaagagactggatagagattagcaatttggagaatgcaatattaagaaatggcaaaggtgagcctacagagattccaaagttgcatagtgaggtttgtgtttgagaaagtggactcaggcagccacgcaaaagagggattaatagaaaaggagactgaggtaggaaaatcaaggcattagtgttgcagcaggtgtgggcagagttggggaggcaatgggatggattcatgagctattaaaaaggtcaaaggagcagggattcatgacccataagtattaattaatacagaagaagaaaatatcagaatgagttctaaattagggcctgagcagctagatgttgggataataacaaaaagactgcaaaaggagaagatttacactttggcaaaaaatgtatatgaaagtatctgggaattttatgccatcattaaatctacttattatgctgaaaatccttgttagctggaaagactaagagaattccccaaggtgcctaatatataaacttggagtagttttcctacttcaacttttatgcggcttattatttgcagtcaatttatatttggtcaatattagttaattcatttatcatctctgtaagattggttaatggaagcagattaaaatccaacagtggtaattttctggaagtcctccagagagactacaaaaagccaaaagtcaactttaatttttgagtacttttcctatttaaggttactgagataaattgtctttgctagaaaaaaataaacagtattgccaattaaaaactccatttactatagaaatattcctgattattttacctttgggaagcaatgcttgttgcttgaaaattgtatgagcctcaatggttagtggtggtaaaatggaagaatgcatactgcagatgggttacacatttgtttgtgttctatattccaagtcacaaatacactgctttgaattgtatttagtcaaacagcagatttgactaatatttccctgaattcaaatagcttagattaattaagctaactgattggttatctaccattatatagatattacccaagtaatgttgtcaaaataataattaattaaactaaaataaatgtatggccctgagaccagaataaaatgaaaaccaagaataaaatgaagtttgccattaccgggatgtattcaagttcagcaaacttatatgtgtagttaagatgctttacaacaaaatattgcattttgttatagcaacaaagtattgagcagcttccaagtcactaccttatgtgtattattcatactagtaatattggtaaacattagtgatacaattttcactaccaaaattttattatatttttcttagccaatacatggagcaaatttttataaagtatttcttgtcaaatcattgaattcctcctccccaacctttaaattccctagtcgccaagaatcttgggttccacaccaccactctttgcttctgttcttaaagttgttgccctttgagcagtgggacacttcatggtcatttatgttatctagtatcttgtggtatgattttagtattcattcaagcattgacaacttttcatgttgattcagattttataagatttgattacagtgagtttataaaatatttcagttatatatgcaatagaaacgaagtatcctattttggaagataagtctaaggcattcacagcaataaaaaagaagtgctttagtatttctggacttcagtcaagggaattattattgtaaagcactaataatgcaggtttagatatttaaccagccatagataccaggaagccaggtgttaaatcaaagaaccaggaaaccatgagccacaaaagcatcagtgtagcagtgttttaagtattacgactatatggacctgcaccctaaaacataaacaatggtgtaccttatgaagttaaaaaccctatttaagactaagaagcactttagcctggtggggaaagcagtggttatgagtggaataaagactggaaaatttgcttttgtagtgcagagctttagagcaagcacagttttatttatttgccttaaaccaatatttccggataaaaggtatatttttcttgtggagattgtagaataactatcattagcaaaggcagaaagtattcatttcaacttagtaaagacatattttttcactatcacagaaagatgacctttacataaaaattgttacatatacttccatagatactaatagtaagtatgatttttttttaaaaaataactttctaagacaaatggcaaaggctttctttttcatgaattctttggttataaacaggttttgagtgatttttgttctatgaagtattaagtgattctgctgatatctgttctgtgtgtcctttgaagaccagaatataattaattttattctggtctaacatatttattctgatttacattgcttttatgtaacataattacagaatgaaaatatacctttagatctgacatatatcgttgatgaagctcctgctgagcatgttgcataagcttttcatccttttaaaactaaaaactcagaggctcttaacaggaaggataaacaaagctgaaatacgaactctgtatatcttccaatgattctcgacatgatgttttgtattcactggcccagagactcctgagttaaataaagcataatcaaatataattagtatgttctggttattttatagtaacttactatcactttagcaaagcaaaaaatactgggaagtgagggatccaatctactgccaaaacagagctcctactctaatgttgatgaactaaaaattttgaatctaatcagcaaagaaagttagcttatatgcataagtttatacccccaaatatatgggaataaatgaaactaaaataacagaaaatccagaaaattttagaggaaaacaaataaagctacatgaaaaattgtaaaagaaactagtccgtggtgataaaataaaatatgtagccagtgcaaaagatttacttctagattagttgctatgtgccctctggtggaaaatgatttatttttgtataactatactgtatattttcccctataatagtgttaacaagcatatttgagcacatcataaatgaccagatcttttatggaactaaaaaaaagtaactgattgatagatagcctatgtatattgaatttgaccttttatttggaatatcattcagaagtaacttacattttttctatgcctggggacattattttctataccattgctatcatctgatttcctgcacagaaaacaaaaaagaaaattactaaatgcttatattatataaaattaagtcagtacatcactgatatggctatcaggttaaaatgtaaaatgtcaatacggacagaattctttcttcctaaaaatgttttacttacaatgttgaatttattttatggcattgcttgaagaggagctgttaccacaaatgatagtgacaaaggcttgttgattttatgcacagggagaattgcttctccccaagcatgagtgaggacttgggcgtaaagaccataacttatgtgtggttttggaaacatgcaaggtaatagccaattaggaggtcagccaacatgtgtgatattggtgctatacatttgtatgcttattacactgaaatagaggttaaaaatggttctttttccacccaaagtttatcagagcaggactacaaatgtgggcctcagattctaaagattgacggaaactaaataaccagtatgcataatgaataccttgcccttcaaggtcttgggggcaggcgtcaattatcaaatcataatgcatattataagacagtgttacttacaattaactgataattaatattttctaaaaaaaaagaaatcccacgagtgcttgtttttcttttgtgtgtactcttcaaaagcagaataatggccactaagaaaacacctcagcaactattgcaagaaatggtttgagggacatcaagaagctcattgttctgaatgatttcaagtgcccttgatatttgtatacaatctaaagatagtgaaataacctgaagaaaaactaaacaccttcagtgatccttatggtgctatacaagatgagcaaaatgatgtacattgatccaattttcagaaaaataattcatcttttacactatatattgaatccattttacattgttcagaagtgatggtccattccacactgttctggtaccatcctttcagagtgtgttttaaatcagaatgcaacttccaaatgtgagctcagaagaatggttagagacagtgggaggcagagctcggagaatagaggaatccgagcaaggttctgttttcaaatatgtcaatgactgtcacgtttgttatatgatgctaagaacaagaaaaacgccaatacgtggaaataggaaagattaaaagttcaaatcaacataaataagatatctatgttctccagaaagagaagggattctcttgggagagatacaattcccttccaactatgggagtctatgattctaagacaacattgcttttctctatctggtgttataggatttctgatgtagttattttgtgcccttaacttggaagctcatatcatattggtttattttagcagcctatgtgaatggagtcaacatgattatctgaataatgtctacaaacatctaaatgacaactgtctgctccactcctgctatccatgcctgtaacactcactccatagagctcctgttggctgataaactctaagtgccattttgtgttagttatagttgctcaggccttccacttctcaggtttcttgcagcaactttaatctagcctcgttttcctggactccagcccttggctctattgttcaggctttaatcccagtcttggacacctctgtcactggcctccatactcagttctctggcttcgaggaattcggaactcccatctttgccaaactaaattacatccctggtgattttatttccagacctcctcatgcttaactctaaacaaaggctgtgtaagagaacctgtggcacaatttgtgttctctgaataataataactaatagaattctaggccagtgattttcaacagacagaggatcaaaaccatttgtagatgttttcaagaaataacagatgccatagccccaacccaagaggttctgatccaggagattcagcaaggtctgagcaactgtatttttttaaagaggctcttaagtgatcaaaaattgccaggcttgagaactattgctttaaaaataataatattaaatacttcctgatggttactgcacaccttctgtgcaccataacctatgctatgcatttacacatatataatattcattccatccaacaacctcatatggtgagtactattattaaatccattttgtagagaagaaagctgaagtacagagaagtgcaggtagtaagtgatgaagaagaattctcacgcaggtaggcagacttggaaagccactttccaccaccacgtggacatatacagaaaatactcctctgccttttctccccctaactgcaaacatttcattcaattttatgtttccctgtattttacccaagtgaaaattaatctgtaaaaaataatacttacagctgttcaatctgctcaaattctttcccctcatctgtgtaacaaaagaagaatttgactgtgaagttggtttgtcacttttatggaacatatatgctcaattaaacctccttcctaagtaagtaagtactatgctgtttctcctgtttggaatgaaggagagacatgctaccttaaacacctacacctcctttatctgcactacagaccttatctgcatttctgatcaaacatagtttagtggcctggtattttcaaaaacatgactgcttagtttgtcattatttaaatcattaaaaatttagtataaaatcaggaaagaatacaggacgtaaggtcaattttctagaggattactgctttatcaacctgtaacccatcaggcacaggccgcaaaaataggacatgacaggatggtctctctttaatgagaactctggaatggttaataaaatatttttttaaatgataatctaagtgaaagaaaaattgtttcttttagactttttatattaagctatcatagatttttctaatattccagtgccagaatacatatcacctaattggtacttaggtaccagtagcaccaaaaaaaaaaaaaaaaaaaaaaagaggggggtggtgggggaagagaaagaaaaaaggcatttttaatactaagttttttcaggaattgaaacaggaagaccatgggtatatgtttccagctcactgtcaccattgttgtaaacctaaatactgctccaaataagaaaatgaagattttccccaaaaatcctaaagtcattgcaatgtatcaaatcataatccatatcataagtaaatgatacttataattaactgataatactttctaaaaaaaacaaaaaacaaaaaaaagaaatcccacctgagtgcttctttttcttttgtgtgtacttttcacaaagcagaatggtggccactaaaagaatcacctcagccactattacaagaaatggtttgaggggcaccaaatagctcagcaccacaagctcaatgtgttcttcactctcgcctaattggaatagtgcacggcaccagtaagattccccatcttcctccaaaagttgtgttatcttcagctttgtttcgttagcatatgttccattgatcacatatttattcatttgaacaccaacaggaacctaatatgaggagacattaaaatccattcctatcatagcacataaaagatacatgacatagtttttcagtgaaagctataagataatgccaacaatattgcttactagagaaaggcatattaaagtttgtgagaggttatctataacagacttaagtcttatcagagtttgatctcccagggagcaaacaaagaaaaaatatatacattgctataaggatttagcagtgaatgtttaaaactacaaagaagcaaataggtcatcatgaataaatattatagaagaattaaaaacagaaaaatcccaatcatctgagtctcacattcctatccttgcctagtgctttaaagtactttttccttcacaagcacaggcacatattcaaacaactaccaccccggaagctactatttctgatcatttctataaaggaaaatcgctcactcagacaatgtgatttccccaggctagaaatgaagatgaaactctcaggcttttggagctgatgtagatagaatggaggggaccctctgtgagcctgggatccgaagtgaactgcacaccttctgtcttttcatatctgaatttctttctcactcagataagctggcttctaagatttgctgggttttccacagcctcacaaggtgccatattaagctatttggggctgttttatttaatctatttaaattaaattttattcccaagccatttgatgcttttcctgctccatcactcaaccgtgctattcaataaatgctaatctgcatacaaatattctcagagcttatccaaggaataattatctgtgagtatattattcgtgcaaaaaaaattacagcaacctggcaccatgtgcacaacactgcctggaatgtttggtacagattggtcagagctaatcaatcaaagtaccatatttttaataagtacccagctgattctgatgcacatggttggtctacattttgaaaaggcacttgtgctcaagttttgacctgcatcctattccccaaacttttctcacatcctaataagactcatgcttagagtcaaattaagaggataatgactagtatagcaatggacaaaagcactggtacgtctaaaacgacattttcaacatctgatataattagatgaaggctaatgtttttcacatattgttgtaccacatacacatcaataaataaagctgtgtatttcaaataccatagttgacatttgtttttacaaaattacactttttaaaaaaaaattacatatacacaatgactgcctttcctcatcatccatcagaagacataaaggagtaggaatggcttcagtctgcatctatgggatttggttggaactatttcattgaaaaactaaacctgttagcacagaataagtcacactcccttctgaatcatctgtcatccttcaatagtctataataacaccaattttgcctaagaaggaatttaatatttcattgtaacatctacactgtctcacatgttccttctacaattatagcttgcctttaacgggactttaattgtaatgcttcttagtgccagggcaaaggaagggtgtctcttaaaggacaatgtcctaaattttcctgccattagaggctatttggggagaagaaaggaaaccagaaattatttataaaatactcatgtttttcttaatatcagctctttgaatagcgatttctctcagtaaaaaaggaattaaaagtatttggcttctctcaggtagcttgaaaaggccaatgacactttctgatagaacctaagatgtaagattaagttacaaagttttcattattttctcaaatagtgccactattttgcattctatcacagatgtttcaggagacagaagcccaaaaagatgtctagcattttttctagttactttcatggaatgatttttaaaaagaatattttctaatggggttatttctaaactaggcaactacacacaaaatgtaatttcttttcaaagaatgtaattaaattgttaaacctaaaaaacaaactaccagctaatgaaacgttaagagtatcttcatatgtataacgtaaacatgccaaaaaccatcaaatgacaactctgtttgtcactgctctttctttatgaacataagctaaacaacaagataacaaaagtataaatcatcttaggaatgctgagtctgttacaatcttgttattttttaaataaatgttttctgttgttgttgttttcttcaaatcaaggaactatcttacctttacactcccattactactgtaccaggtccaatttaaaggaaaacaattttgacatttacatgtcaagacagtagaatcccctacgtaagagatcaatggcttgtttttcccatgaagttcagggactgagaataaaatagagaaatgtatgttactgaaagagtttaggtaaaggaaatgtattaaatgtgcaaatattgtctcctttcattttttcattacattattttaagtactttcagttatatatcaatgaaactaatttatagtagttagggtgtagttagtagtaataataatagtagatagattcgatataattgtctccaatgtatagaaatggaaggtcttctattattgagcctaacaacaaaagtattgttcctttttggataagttaaatgttttgggtaagaaagaggcttcatgttttcaaacccctgttctttcttcccacctactaagttaccttagagtaattattttcttcaaagttttaacctcaggtagcatttgagtgagcagataaaatttccaggataggaaatctttagttgatactaatttatgaaaagccagcaaagagttagagaaggtgggaacaaggaacaaaggaaaattaacagaaagagaacagcgtaagaaagaaaataagatttaaaaattctttcatgtggttttgtaaaatatatatatatatacactaatatccattatgataaatttcctagtcaaggaagtttgaagtagattccattagaaacagaatacaaatgagcactgaatttagaaaaaaaataagttttaaggatgtaataacttggtaaagaatattaaaagataagagcataaacagtacaataaaaagcctacatggtgcaatcagttccttctgattgacctttaaagatgtattatagaaggtacacttacactgaagatgtagactcatcaactaagattattttgttaatttttttcttttacttttttcaattttagcaggttttttgcttcttttggttttgtgtgtgtgtgcgcacatgcgtgtgtttgtctgtttacttttttcatttatatgtttagtttgccagtagggaaagaatggatgaaatcatgtcaactaaagacctgcagataagcagagattggagcttggctaaaatagggattctttgctgaagccacaagtttccctacaacctgagaggaagagcagccacacttcctgagttccatctgaagaggcacaagatgcactagtgcattactagggcaatgacctcaacagccctgttaggctcaccttaaaacaaacactgttttggagtgcaggctttgcattagacactcagtaattaaggacacagtttccgctttcccaggttgtttatctctcagatatcctatttctcaatctctacatgtttctttctggcaattgagtcatgctttagcatgaaaatatgtgttgaaataggttcaaaataccaaaatttacccacaggctaagaataaaatgtggaagaaaggtaattcttggggaaaaacctggcagaatatacactgcttttcagtattccttgaagagctacctgcttgggaagcataatggaagctgcgaggcgcttttcaagaaagttgagtattctgagatttgatgaggaacacatgactatgttattaaaccatcccaactaaatattaagatcaggctgtaaattgcaggtagctgacaatgactgagtgacaacatggaaaagctgaaaccaaaattctgttttcttgccatctcttcagttttcttgattatcccctagactaatgactaaaataccataaaccatgcttttgttctgctatatatggctaataacagcagtgtggatttaaattataaaatgcactatgttcagggaacatgacatttgtttgaactattctggggttcagggccacagcttatatttggaaatatttactaatataaggacagtgagacagtattctaatgtgccctgtcgaccttttaagactttgcataaagtaggatgcatacgagtgctacggttggaataaaccaggtttgaaggtggtgaaattgctgattcaggctagtttctaggaagatggggtttggatatacccagtgaaagtaacagctctctggagttgtaaaattggagactatatttgtatattcatgaactagaacaaattggcctaaatgtcatattggttcaaagacttttaggtaccactaaattaggaaaaaagattactccatgtagtaaaagaatgctaactatacttcaacactgggatccagggctgaagtcctagctgattctattatgctacctttccatactttatatttttagatacttccaggggaagacagatagttgagctttgacaggcttcactacatttggtactatcaaaatctcatcatgacttccaaaaagttcttgttctttaccaattaaatttctgcatactttctactaagagattttaacactgataaatattatggaagctttcagcaaccactcagaatatttgatccactactgagaaacactatagaccatcactcatctttctctttctcgggtggcaagtaatcagcaacttattagcagtcacaaacttccagtgtacacttttgctgtctcctctgtcctggcatcaagagcgaaacacataaagtcagcaggtttttgtgcattgaactaatcagtaatcttgagggccttttacaactttgtagtagtaaatcaaccagcacccataaagacagcagcagggactttgctgatgaattgttctgaagactcaggctcatgcactataggtggctcatgtagtcaatggcagaaaaatttatctttggttcaatttaaaatagagaataaaacagtcttttcatctacatgcagttgtaagtcttctaagaaaagataattattcttcttaggaaaaaccattaagtaaaccatatggagaaataatataataggacatttataaaaatacacaccattttataagcctttcagacctattaaataactataatatccataatgtacagatgtctttaaatactactcaagtaaaaattatttctgtaagcaatattcaatttagatgaattatagggaatttttattttaccaaggaagatttaaaaggacccaacttattaattttataaatatcttcaagatataatacatacttaaaagttacattaatgttaaaggggcattaaaaacaaattagctaacctaaactgcttcaagacaactagaaaagaaaaaaaagtaaatgttcagtgattctttgctttccttaaagccttgatttaaatcctaggccttgggtcagcgctgctgacaccagccaaaatcagcttagttatctcaaaacagttggagaatcaagaggccttccgtgtgaatacttgcaattcaatgtattggtatgttgaaaagtaaaatgcttgttaatcttcacattagacacaagaatggtcacttccacataataatttaagtaattatcaaaactaatgagaaaaatgtgttatcttcaatattgaaagcaggtatgactagtatatatttccagagcacaatgtcttagaaaaaaaaagaaaaaagtgtttaaagttgaatatcttgggagcactttaagtcacaagattctgtgagcatttcctcagaatctgtaggccttctttacatattttttaaaaactcaataaaacatgttcactgaaattttgtgtgtttagtattattttttgctcattgggaagaaaaagagaaagggaggaaaaaaggaaggaaggaggcaggaagggaaggaaggaaatgaactcaaaaggtgggagggaagaaaggacagaaaaagggaaaggaaaagagagattaaggaaagaggaggggaagggcagatggggcaggggagggaaaaatgaaatgcataaggaaaaggaaactgaaaggaaatgtatatggtgttatctagtccttcaccaagttaaaggcaaatggagggaaaaaagttaagaaagaatatacatgactaaaataatcaaagaatgatactagtttctgcttttggagagaccaagatatataaatacaagaatttattatattcaccacattggaacaattacaaagacataaaaataaaatgactctgtgagtgcagaagggatgcaatgagggacacaggagtgaaccattagatcatggcaatggtgaagcaagccattctgctattgatggagccttgagaatagcatccacattctgtcacagcagacagtcgggctttaggagttttaggaaaagttacaacaattttcatgtttcctggggaattaatgcaaagcagagtccgacgtagttaatatggcgacagattgcatttcccaaataccagcacgataatatggttcactaatcaccacaaaatactgggtttttcataatgataattatctaactcaaataactagtctttattatgagattgagaccttcttgagttttggtttaatgatggtaacagtaaaatattttaattcgtttgtttccaagcaaaagaaatgtggatgatattctgtggcttgtatatatctttaaacctccttacttggtgagataaaaagtaggcaaccgtttgtgcatctccatattatttttaagttttatggatcctaaaatcccatgtcctggagctatggatatagaacatcaacccacactctcagaggctgggaccacaataacttagaaacgtggaggactattataagagctatgaatttagagagataaataaagaaattcaggcaactgatataattcactaataatgtggtaggctggccttttgaactaaaacatgtgctttaaattgaggaatagaagcaggaaggaagtggacttgggggatacaagaccattttcaaggctgcctcttgtggctctggaaagcatatgactttctttcagctacattatgtttattattgtaaaaataattttaaaattacaggattgagaaatctaagaacataatgctgaagttattaactattcctcaagttattaatactgacctttgaaattaaatgttcccctttgttccttttcctctcgaaagaaacaagaataacttcccatttgtttgctattaatgatggtgaacctaaagataattcaagttattaatataggcttagttctcaaaaccttaatgaaaatgaaaagacttagccattaataaaaatttaaaaagagaaataattctgtaaatatgcaaattagaatattagcataacattcaagtggctgcagaggaaagaatgctcagtcagcaaaaatatttagaattaagctacttttggtgagcaaggtaggttaaaatttgtatactcacctgtattgggtatacaaggtgcttcctgttgcactgacaagataattattctcaagttgttcaccatcttttttccaagtcacatttactgcattcaaatccccagatgttgtgaactggcatgtgagatttacattagaaggcctttctaaagtgatatttttttctactggcatactagaatgttctattagcacaaaagaggacaaaatgtgaaagttatattcagaggaatctaacacataaaaccttttatattattaacagcagtgtttcattgacaatttcttaatgtaacattcatttgaagaattattcctctatcaacatagttggttccctttcttattcccttttatatgcacacctaaagaaaagttttgattcaacattaacacaattaaaaaaaacctaaagctgtgatagttatctccttaagctctatactgagcagaatatagggtagagagtaccctataacatgtgccgtatgctctgacagtgtaaaaacagcacaactgtaaatacaaacacacactcatgggtgagaatggaatgcctgtttcaataattttgagtaatcatgttgttagtagttattaagttttatggatctaataactactagagaatgttttgtgtgtaacatggatttgagtgatatattatattctaaccattcctagtcttcttcagaacctgtaaggactggatatagacataggtacaagacagagaatttaaataagcatccagtagttctgaattttgactgaatttcaatatcagtatgaattcatgaggtgtttatccttctttttgactttcaaaatagatatttattttggattgattgattatcataagaacacttaacattagaccttccctcttagcaaattttttaaacttgtacctaaaaagtagtctgaaaggttctcaattactcttcccatctacaggtgggaagagaaggagctaacccttagagaagctttagggaagttgaggtgtttatcttgaaaacaatacacacacacacaccacacacacacacacagacacacacacacacacacacacacactgaaggggtccagaatatgcctggatagcatacaaattattttgagcagaaggcatttgagttcctaaaatagctactctgactaaaagcagagcctttcaaaggaactccaaaaaacctccattgtcataaatcccctccctaggagcaatagggagaatggagtcatcactgaacatgagaaatcttcacaccacacctaaacagacactgtcacaaaactatatcttccacctgttacctaaagggctcatttatctttcctaaaactcatttcgtttttccataagctgcctttctctcctcctctccttaccctactaagatggtgtataagcccccacttttaactggccctttgagctacatgttttggtaacttttgtccatatgttattaaatacgctttttgttttgctaatctatcttttgtcagtttaattcgcggagcctgaaattgtagagaattgcagagaaaaagttcctccctgacagtttggcaaggaatatggaatggttaggactccccacccttccactccaaccccatttctaaagcctgagatttcaggacctctgacccagcaggtaagtacaagctttttttttttttacaccagtatcccagaaatctgggatttctgggatactggtgtaaaaaaaaaaagggtgcactagagcaagagcagtaagagcctctacttgtcttttctttcttcagtttaaccctcaagttcccaaccactaactatccaacaatacacacatacatacacacgcgcccacgcgcacacacacacacttagggaaaacacaaaaaaactaactttaattttgaacagtggcaaataaagaaaaaatattaagcatgtaccttgtttgtcctacactaactgtatcactggctaaccaaacagtagagaaaataaacgttctctttatagaaaaattccagcaaatgaataaaaaagaaatcatacaaatataccataatgatgctgcaacccctagtgaatcatggatctaggcattttgcatcaactgctgcaataatttcaaaaacagaattatgtctctcttgaggaagaataccccactacctaggatatagtcttgttaaaaaaaggtgctggaggaggttcttgaaactggttaagtctctggatccaattcccagtttacaggaaacatggattatagaagaacacattaacctacatttcatgaaagtaatcaacaaaatccagattctgggaaaattctacaaataaatgatctggttttttctttttctttctttcttttttttttttttgagatggagcctcgttgcccaggctggagtacaatggtgtcgtctcagctcactgcaacctccgcctcccggattcaagcgattctcctgcctcagcctcccaagtagctgggattacaggcgcctgccaccatgcctggctaatttttttgtatttttagcagagatggggtttcaccatgttggccaggctagtctcaaactcctgacctcaggcgatctgcctgccttggactcccaaagtgatgagccaccgcacctggcctggttttttcaatagacaaattttaaaagggagagagatgtctttgtatcggacgtcaggtgctatgtttggggcacctgaagattataagatactcaaaaaatactattaaaagaaaagcaaaactgaactgtaatatttagggatgcatacctgggtaataaagcaatacagaaaagcaagaaagtgactgcataaaaatcagaatagtggtaattactcttaaggggaagagaaggagttgtgtttggaagacggtagtatatcatataaacaaatttctcaagctcttctcattctcaataatggtatagtatgatgaaatgtagaatgcagagccaaaatgtagaaagaaaaataatacaactcaaataaaatggtcaggtgcaatggttcatgcctgtgatcccagtaatttgggagactgaggtgtgtgggattgcttgagcacaggcattccagaccagcctggccaacatggtgagacctcatctccacaaaaaaaaagaaaaaattagccaggcttggtagtgcatgcctgtggtcccatctagtctcaggtagaggtgggaagatctcttgagcccgagagttgaggctgcagtgagctaaggtggcactactgcacgccaggcaaggtgataaagcagggccctgtctcaggcaaaaaaaaaaaaaaaaaaaaaaaaaaaattctatcacttttaattacatttgaaactttacgaaatgcttccataagcaaggaccagatgcaaggtttgcagatagtgaagtacagctcgtgcaaagtgctttgtgagcacatgcttgaaataactgcttgtaaaattgcaaaattgctgaattgaatttaatgctcaaaaagaaaaataatatttgatgtctctagaatacatatattgccagagactaccttattccttgcagttccctttactgtgctctatttcactatcctagtatattttaaacattttgctagccacaccaaattattccaactaccttttaaatgttggtgcccatcaggattttgctctctggtctctttacttctcaatttggcacttctttgttggattcaactattaactctaatgctctttacttgcaaaattagaacctccactgaagtcgtttttttattttacagctccaggtgtctacggagcatctaaatctggatatcccatgagaacttcaaactcaaaatatccaagagatccattaatattcccttgtgctgacctataacactgaatcacatgcagtagtatttagttgattctaccgctaaaatgtcaaacaaatttgcccagttttatccaaccctcctattattggccttcattatctttcaccaagaccaggtaaattatctaatttctcttggccagcttctcttgctccaaccaaaggacaactttggttggagcaatttaagcaaaactcaaattgtttaactgccttgattctataccttgcatgtgcaaatcaaagtatctttgtattagacatcagtttccttatttgtaaggtgggacaataatattccatgagattgtaaaaagttctatcataagaaacgtcaacagtaatataatatagcaattaataaatgcccacttacttcttctcaccattatctcactggggaatattataaaaactatcatatatggtgctaagggttatatgttgattaaataatttaatcttcacaacagctttatgaggtaagtatcactgctacaattccaactttagagatgaggcaaagagaggctattttgtctaagattacacatcaagacaaaggcaacactgaatctcagatttaggtatgcctgagtccagactgtgataaccaacagaatataccaactctcaaacatattaaattctcattacaatggaattaacttcatcaccttcaaactgttgaaacaagattttaaataaaagaaaatattaatagaagattaaagaaatgtacagtgtagctatataccaatatgaatgcgatgataaaatgaacagtgcaatcaaaatattttaaaaatacacattttcaactaaacatagttttacataacttaaagtgcaacacagtttttcttaatggtaggccatcctccaagccctaatcgttgtctcactgtttcctataatactttgcaggtgcttctgcagtttgctgtgcttctgcagtttgctttccttcctgtcaagaaatcacagcatcaaaaacatgcaaaaagctctacctttttacatattttgtggttagccaacaaactaatgtgagctcagtcaacgatgtttcaacttccttaatactgcacaactgcaatgcatttttgctgctttagagtgctgcaaaaacatctatgacatctgcatttctaaaacgataacaatttgttgtttttgaaacgtattttcaagactgttcttaaaaccatatagtaatttatacctgtctaaataatttcttattttcataggtaacatttttaaagtatatgggcctttcaacaatttgcagtcttcagagaaatgacatttagattttcttgggtctattcaggacccaatcttgtaaaccatttcactagaaataaaagtctgctttgttctttattaagaaaaagaaaatatggaagaagccaattaaaatttattgcataggatagtgtttccaaacatgctttaaagatagaaacccttactaaacacagttaagtgaactgtgacatatacgacggattcgatgggacaactctgacagaagccaagatagaaaatacagagccctatcagcctgacttttcattattcataatgaggtaggaggtggaatgtgactctggaccagattgaagactgacagaaacaaggaagaggcaacgaaagatcctctccgtaagacacacccaccagcaccatgacagtttaccattgccatggctacacccagaagttaccatccctttccatggcaatgacccagaagttaccttctgttttctagaaatttctgaataccttgtcccttaatttgcacataattaaaagtagtataaacatggctgcagaactggccctgagctgctactcttgacacactgcccaggggtacccctgctctgaaggagaagtcacagagctgtaacaaccctgcctcaataaagctgatttttctaccaccagctcactcttgaattctttcctgagccaaccttctcgggctaaaccccaatgttcggattcacctgccctgtaataatttcaccataaaagtcaataaagcttcatgatgcaacccaaaatgtctattaaacatccagaatccttacagaaacagaaggccacactaacatgaggccaacacccctatataaaaatgatacaatggatcttatttttatcattaatgttgtgcgtcttaaacatatggagttaacttatgaataagaataaaattctcaaagtttatatccaaaatttataaaacataatactaatcccttgattcttgtaatttcacttctctcccaaataagtctcatatggattgaagaatcatgatggtttattaagtgatcctatcaacaagttatttacatgccatctgattagtgccacaccaatgtgatacagcctaaaacacacgtgcttcctgaatcccataaacttaaaatgtgaaatcaccaatgtgcacagagaaacctgaaattatataaacccaacttgagtaaaatgtagtacatataccttgatatacttttttatatgtatataaaatctccaagtaatccctggagactccctcaagacctatgaactatgtggctggtgttatatgagctgagcctattttcaaacttttagaattttttttacacagacatcctcaaaagaaagagaaataccagaaaacatgaatggcttctacacaaatgaagccaggttttccaaaataattcatcaaagatttggcaatattttggaaaatatgttaaaattatttaagaggagatgctagttgaatttcactaaacaaagctcctatcagtcactgttttcctccacttcatttagtaacagaaattaaggcatgtaatggttatttctctactttctaaactgatttaacatcatttcaaagaaaaacaaaaacaattctgtttgaattccagaattgcatgtctcttgtttcaacaatgcagtatttaatttgagacaataacattgggtaataatccaataattaaatatatttttctacaacatagagaacactgcaactattgtttacatcaattacaggaaaactatagtaaatggttacactgttttagtaaccaaatacatttgttgccactgtttccaaataattaacatgaagttaatccaacactatagtggggaccactgatcatatttttggacaaccagaatccgaacacccttcccatccgtgtaaggtttggtgataggcaaagtactcactcactgcggaaacctaagaacagatatttcttctctctgcccagctgagcactagggtttggccactttaattataaccttctactcatggctgtaaagttagagggagggagttagggacctaggcagaactgaaaattaatcacaatagcaatggcaagtgtctagcagtgattgtgcctcattattctttcactcactcatttaacacttatttaccgaacacctaccatgtgcttttcatttatccactcgttcaacaattttactaaaaatatatcacgtgcctttattctaggccctagtatcaagagtccagtgcctgcagaaatatcttaagcagactcttccagtaatccttgctgtctgtcagcctgaggtccttggcattgccagaacttgatttccagttttctcatcaattctgctagccaaaatcctttattcaacaaattatttcctgcttaactggctatagactgtttctgggcttgagatcattaacctaatccatatacacctatcaagatttacactagatacttcatctatgcactccttccattttattaaaattacatagcactgatgtcacttggcagctcacaaatatctagaacatatgataatacttggtccccagaatgaattctgcaaagtggtaatcatagtaccagttcagcacatttgaaagacaatacctgaggttacacaggggacaagatccaggctgaggtagcagtccaggactcagatcagccagtccctggccctgtatgctcccctccatggccagtcctgcccttttgttcttgtagctataaatcacactttagtattttttccatctcttctacatttacaaatcaaaatcatctcaagccataacaacttgcctccaatctttatatctaatttctgccttctctaccttgataaaaagctttcatttattttgaaccattttgcacatatccacttcaatataatggaagaaaggaacagcaaatgacaatgtcatatcatttgattccccagtacaagaaccatttaaattttgaaatggattattctaatggatttcaaaattattttagtagcagaattgtttcagaaataaatcacaggaaaacttaaacagaacccccactacatacacacacacatacacacacacacacacacacacagataactgtataaaactgataaaaagtgttgctacaattagtgaagactggagagggtgtggaaagcattcaagattggcctcttcatcccttcatctcctttccccatcatggttgcatcacatggaacaaaggacttaaaagtgacacatgcacacgtatgttcattgcagcactattcacgacagcaaagacatagaattaacccaaatgcccatcaatgatagactggataaagaaaatgtggtgcatatacacgatggaatactatgcagccacaaaaaggaacaagatcatgtcctttgcagggacatggacgaagctggaagtcattatcctcagcaaactaacacaggaacagaaaaccaaataccgcatgttctcacttataagtgggagctgaacaataagaacacatggacacagggaggggaacaacacacataggggcttgtcgatggagggcaggggtgcagagcattagggaaaagagctaatgcatgctgggcttactgtctaggtgatggattgataggtgcagcaaaccaccatggcacacgtttacctatgtaacaaacctgtacatccggcacatgtaccccagaatttaaaaaataaaatacaataaaagtaactggattccatcaaaggagaggtaaacacaagtctcagcacacaccagatcaagataagggctcataaatacctaatgtaaactgaaagcatggcctgctaccttggtaatgaatttctccaaactgcaggtgtttacaccctgatgccaatccttgatatttagtcttacaatggtttatgtctcatggtatcaacttctaaggtgctaaccatgcagacactcagggagtcagtacatacattttgtacacaccccaagtgactgattgtctcaggtcacatgcctcctttgcagaaagggctcctctaaccttacaacactgctaacaacagactctctctatcacacttcctttatatacttcctagcatttggcactgtccggtttcacctttcatattaatttgtttacttacttatccattgcctttcccactgaaacatacactgtatgacatcgggggaggagggcagaaagggaagtctgccatgttcaccactgtaaacgaggctttcaataaatttttgttgaagtggttgtagctcccggaatacagtacttaaaacatgaatcacttctttagacagataaggcactttcccttagactgaaggttcaagcatattaaaattctgcctcatgatttatatgaggaattctaggtggaaagtactttacgggatatgcaagaaatgcataagaagttcttgtctcacacagttgactcatccattggccaaaacaaatttgtttagtacttttatatgctatatgtgatatagaggggatttaaaattactaatctagcaggggacatataactcaaacacaaatatctacaattaagtttaactacaacagatactgcaaataaaatgagatctaaatcacagacggcaatagtataaaaacattaattttccccaaaataaatctacagagtgggtgaagaatcagtcaaattccaagagtattttttacagaacccaattttaagaaatgcaaccatcaaaaagtgggcgaaggatatgaacagacacttctcaaaagaagacatttatgcagccaaaagacacatgaaaaaatgctcatcatcactggccatcagagaaatgcaaatcaaaaccacaatgagataccatctcataccagttagaatggccatcattaaaaagtcaagaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattatcaatcatgcttctataaagatacatgcacacgtatgtttattgtggcactattcacaatagcaaagacttagaaccaacccaaatgtccaacaatgatagactggattaagaaaatgtggcacatatacaccatggaatactatgcagccataaaaaaggatgagttcatgtcctttgtagggacgtggatgaagctggaaaccatcattctcagcaaaccatctcaaggacaaaaaaccaaacaccacacgttctcactcatagatgggaactgaacaatgagaacacatggacacaggaaggggaacatcacacaccggggcccgttgtggggtggggggaggggggagggatagcattaggagatatacctgatgttaaatgacgagttaatgggtgcagcacaccaacatggcacatgtatacatatgtaacaaatctgcacgttgtgcacatgtaccctaaaacttaaagtataattaaaaaaaagaagtgcatgtgaaagaaagtccaagaaagaaaatctgtttttttaaaaagaacagataaaaagatatgtttttaaaaataatactaacatgttaattatgccataaaataccaagaaattaatgaaataaaataggcaaaactttttagactgcaagcaaaaatctattagtgaatcaggaaatcaatttaatagttatcaacagatttgttttttaatggattggagtaaaagagaaattatcagagtataacaagcttattaggtgtaggtgttattcgatgaatattctgtttcatatgtgtgtgaacatgcagttggtgcatcaggttgcaaagtaaaatgtacttcttactttgggaagtactttaataactttgtaaaacaatgtaacagtagagaaacagaacagagtttgggaactgaaatatgattagagtgctatttcaaagctatcaggaaaaggagaactattcagttaagaaagttgagacgctggctaacagtacaaaataataaccataaaattagttccttctcacacacaaaacataaaactatatcataaatgggttaaaaagtgaaaggtggaaaagtatgcaaataataggaggaaatataatgaaacttcttcacaactaaaaaacaccacataaaagtttaaagtttaaagtgggaaaaaatattcgcaacttctataaaaagtaaaaattcagtatccaaaatttatgcctacctcatttaaattaattcaaaaaataaaatataagcctagtacgtgggtcagggaaaggggccaactgtcaagatgttttgaaggccaatctggaagtatatgttaaaataaagatgtgcataatttctaactgagcaactctactttgtggtatttatcctagagaaacattcacaattatgcccagagagatatatgtagggtatcccttgctacatggtttataacaaaaaaatatattagccaactagggtccattaggaaaaaaatgtctaagtaagctggtgtatttatactgtgcatacaaattaaaaaaaaaaaaagctagattcatatgcaatatgactagatctccaaaaactaatgttgaatgacaaaaatcaattttcagaatacatatggactaatagcactaaaactaaagaaaacaaacaatactagtttttatggatgcacacatgcacacacacacatacacagcatgggaaagaaacacattgaacagcgtataccattgtaaaagaggagaagagaagagagacagaaatggtgggtaattcaatgagacttgaaactcatcagtcacattttttatttcacctcctgaagttctatttggatattttttgaacctgctttgtctttttaaaaaacagtataatattcattctcatgtttttgatatttatttctctacctagtattttctataatctgaagctctggaatgtctaatcctactgctccttagctctgttagggactgtgtgcttgttttttatatttttgttttgtgacatgttgagacatgtaacagcagggattatgtcaccaggatggacaatgcattcttccacagagggtttttcattgctttcctgtggaagtactacctgccagggtcatttttgtgttatttctcagctcggaggctcctgtacagtataatgcaggtaatgtaaatttgcaatttaaactgtgttgaggacaggcccacgtctttaaataataacggaaatctttggggatttgcaggtttaaaaaaattatttttattcacattatttttaactggcaggaaacactgggaatcttttggtttaaatgcctaacaaaactttaaaagaaataagccaacttgtcatcttgtgctgtcggctgattttcttccctaaatcaaacctttccctatatttacagcctaggaaggatagttttcttcaggttttcagttccaactctcctccttgcatgaactcaaggccttgttttttatatttttgtagctcttaaaactcaaatatcttggcaacaaacacaggaaacctaacacaatatcagttaacgggtttcatgccctgatcaccaattttgatcggtagaaacttctttacttttgtgtacattgctatatatttaaaagaatgtttactgtattttagatactcgtaggtgtggcaggagggttttcagattttctaatttactctaatgctgaaaataatgtttaatattttcaaaacaactcatttttacttgcagaattaaaatttaacaaaaatacagtaaatacatatcagagaagcaggaacatatgcgcttctctgatatgtgctttattgaagatgggatcttgactccattcttagagagaggaaggatttgaacaccagtaggagggagggaagagacaggtcccacttacagagtgtgaggtcctgtgcctgtgattcagcaccatcatctaactttatggtgagattctttactaaatgttaatcacaagattattaaatcatgtgtattcccaagataaggggatgggaaacatgcaggactctcatttttaatgtatagaacagtggggataattttcaaatggggaaaattttgtaccccagggaatgtttgacaatatctggagacatatccagctgtcataacttagcaggtgtcactcacatctagtgggtaatggctaggaatggtgttaaacaacctacaattctgcaaacaacctcctataaccaagaatcatccagccccaaacatcaatacttctgttaatataaacaaaaacaaaaaaaactgatattaaaaaaacaaaagttgatcgcagccactgccacttgtgttgctatgggtagatccctcttccatctttactttctctgactctctatgaatgttaggcctcagtttttttctctgtgcatcaacagtctacatatcaagtttgatgagtacctctgaaaaaatatcctaacacttgcagcattggagtcatgctagaatcttttctgcaataaagtattttcacttcttttcttcttctcaatcttctcaatcacctgcccctagaatctgagtggtcctaacctagacctcttgctggccgagatttagacaatgtggttgtttttccttatcttgactaatcttcccgaatcttacattgtgccttaatttgcacatctgcacctctaatgtctgcctatattatctccttggctcacaaggaccttgtgggagagctgctcacatctcaacatgtaaataaaatgtgcctttgggtcaacacaggagaggtgattccaacgttaacaagttggtcaaggaaactgtcagctgtttatttttatttcaatctcttctgttaaactataacacactgattgagcaactaaacactaatatgcagagaggaaaaaaacaaaaaaaatatattgtggtaatacaaacaatacaatgaattccaaatactatggacattggaaaattaagtacagtgatataaaaatagtccattaccaaaagatctgttttaaaacctctgagagcagaaaaaatacttttagtttcagtcaagtcaattactttcacaaatttatgattaagcaagtgcaatttctttatttctgggggggcaggggagatggactcttgcagtggcacaatctcggctcgctgcaacctccgcctcccaggttcaagtgattctcctgcctcagcctcccaggtagaagggaatacaggtgcccaccaccacacttggctaatttttgtatttttggcagagacggggttttgctatgttggccaggctggtctcgaactcctggcctcaggtgatctgcctgcctcggcctcccaaagtgctgggattgcaggcagcaaatgcaacttctaaagcaatagctttattactaaataagcctagaaatagcaataaacctagaaaatagctttattttcattgtttactacatcatttcaaaactaatgtcattcttctaaaaataaatatacttgatttaataatgctgttaaaagaaacaagtaactgggcattatgcccagaaagaaaggctgcaaagcataatggctaatagcacagactgggcaccaagctgcctgcattgaaaaccataagctccaactcaggaactgtgatcctggtcagttcacttcgcctctttgtgcctctctttcctcacctgcaaattacaaatagtaatagtacccacctcattgagctgttataagaattaagttacttagaaatacaaacatggtacatagtcaacatcatgagtttgttaataattagcaatattttaaaaatattaaataagtaagcttttatgaatcaaaagccatgttttcattctcccaggcacaagaatccatatgttttccagtctcgagaatctttggataagtatgtatgtcaagagccagaccaaaatctttctggtccaaaatttacaattaacgtattgtatttgaatctctctacaagatacattttatcctaacagagagattaacttcgacaatggccagagggaaagagaaaataataagtaacaacatagaaatgttataagtattgtttctagacaacaatgaataatgataaaatcaatattgatacatatcaatgttatgaaaatatgaaaacactccatttacaaatagtaggttaaaaatcttaacagcagtaagaagaaagtctatggttcataaggtaaaaattgataatcaggaattggagttatcttgtcattttcaactaaattagagtccagagacccagtaaaaaagaaaaaaaaaaaaaaaaacacttaggacacaaagcacctgcccggggctaatactgcaagctagctgctgaaatgacctggtataactttaagaccagttttacctagcagcttctgaaacaaaccaccatgactctaagactaatttacccaccaccatcactcaccagtcagaacttgttagctcccaaaaactttgctagtgctaatgagttttcttccaaaacaatatataacatttctctctaataaaacctctaaacttctctttggttttcagtcatactgaagaccattccactctctgtgtaagccctgaactccaattctgttctaccaaataaaacattttgtttagagattcatctcgatatttttattttacattgacactaaaaattataaatatatcttcaaatttaaattctgtagttcagcaaaggtagtttctaagaccaaactttttgatgggaaggcactagagcaacaacctacatggaaatgtaaccattcagtgcccaactctgagatctaatgtttctaaattaatgacaaatctttgtcaaaaacaaatccaaagttaaatgaagacattattattattattattatattattattattattatttgacagagtctcactctgtcccccaggctggagtgcagtggctcaacttcggctcactgaaacctccaactcctgggttcaagtgattctcctgcctcagcctcccaagtagctgggactacaggtgtccacaaccatccccagctaatttttgtatttgtagtagagacagggttttgccatgttggagttccttgcttgcttctccttagcacagtgactcatttgatatcatctttaatttctctggctaaaggttttccaacagatacacaaattctcttcttgacctagagtgatgtaatggatgtaccagcaagaattaatgaaaacataagagtatctgcaaatcaaaattgattctcccttttctcaggtatccattttctggggagccattcttagccttggcatgtctggtatattttcctcctttgtgcgcccccagtaaaacgtcctcaccacattagattcccagctcactactggtatgttttcccaccaggccaggaacagggattaccacttcgcaaagcaaaaagcagtagctttgtttaagaaaaattgcttaaaccctttttttcgaattgcattatttgaaacatgatacatttaccagtcagtgatatgttatgactctccaaggaaaagttatttgccattatttcttctctgagaggtggacttgtaaaaggcgaatctataagagaaagaacacatgattacacactcttatcaagagtaaatgactatctaaaaactactttgaaacagctaaaacactgttgtgaactattaatgaaaaactgtgttttcaggaagctcaaagtcttatatacttcaaagacatttagagatatattaggctattaaatgtgaaaaaaattctgattttttttcttttttaacctaaaaatccctactgacttacatcagatggctttttttaaataacgccttccatttttattctactattatagtttctttacaaaacataaataaactgaagataccaaggaatcagatgagagagccagaaaatggaaagatatgaagaggcagagagagaagatgaaagaagagcgacaggcagaccttaataaagagaattaaaaaaaaaaatagatagcactgggcaccagggaacagagaagataaaatggctgacgggccagtttgggttgctatttgttttctagctacggttaccaagaggcatgccctctaacacctgactttcagtttcctctgcctctgtcacttctctctccttttgaaaactttaattaaagaaacaaggtttctatttccacctctctcactctcttcgaagttactttatttattttatttatttttatttttatttttatttttattttgagatgggagtctcactcagttgcccaggctggagtgcaggggcatggtctcagatctctgcaacctcagcctccccggttcaagcaattctcctgcctcagcctcccgagtagctgggactacaggctcccgccaccacgcccagctaatttttgtgtttttagtagagatggggtttcaccatgttggccaggatggtctcaatctcttaacctcgtgatccgcccgcctcggcctcccgaagtactgggattacaggcatgagccaccacacctggccaacaacatggcctactgttccttttattttagagtaccagaccttaccttccaggaaactactcaaatatatcaaagaagtcagagaagggggaaaaaaagcttattattgtaaacttggctgcattatttaaattaaatcccattcaatttaaatgaaacctgagccatttttattacactttttaaaaataatctgctcagaaagttatttctagtacaagattagatttccagttctttcattttcttatatgtaaaagttagtgatcacttttgttactttagctttagaacattgcttttacaatatcgcctagtaaaataacgtacctagcagaacctaactctccaataggctgtgttccaaaggtttaatcacttctaaaacagctttagaagtttaatgcactttctaaaccaccatggcacatgtatacctacgtaacaaacctgcacattctgcacatgtatctcagaacttataataatttttaaaaaaagaaaaaaagtccttaaataacatattaaatcagactaccctctcacaatgattatataggaaaatatgtcctgagtttctcactaggctatcaagtatacaaaacctttcctccagtcacatctagtattcattcattcattaattcattcactcattcattcatatttgtacccatattctcccattctccctctcctcccatcaccctccttctctgtcttttcaccccttttctctcttcctcttccctctcaccctccccaactctctttctctctctctctctctctctctctctctctctctctcacacacacacacacacacaaacacacatatacacactgcttaaaagaaaggctcccataaatgttattttcctaatgaaaattccttgtttccattcttggggctagcatacttagaggttatattaaagacaaaatatttcaggaagatcaaggcagatgctattcacttatggacaggaagccaggcgggggtggatgagaaggaaaccgctattctactatatcatctgttctgtgaagcctgcaaaacgtaagctttgatatctttgctttcctccccagggataccccactgtacagcagaatacaatcttaagggttcttattatactctttatccctgaaacaagcccataacctttttgagatttccagcatcatttattattatggttcacagtatcagtaacaataagagtgacataaactaaagaaaaaatgctttctgtcattcttattcctattccacttaagtaagtgaatatacacagtatctcatgcacacttggtactgatggagaatatgaagctgggcaaacttggtccttaaagggctatgtggatcataatagtaggggtttgggtccataatttgagattgagagtcattaaaatttcgagcagcacccattaatgcatagtatataactatgcattaatatataactgtatatatagttacagttatagtcagtatataactgactatagccagtatattttatacaaattggcacatgagctagagtatgaagcctgagcctggaggtggaagaagggtgaagataattccaggaagatgagctccaatgctggggctattctcccttactgatcactaggacttgtcatggatgggctcaacagggacctgtgttagaacaaggagagaaaatgagtctaagtttggctttggcagaatctaagctgatgacagttgaaggataggaaaggaaggaaacaccaagtttccagaggtagggaagtctgggtatttccagaatatactagctgttgaggccatttacaattgctggctcacatattaaaaatacaatcagacatccataaaccaaacaccaccagtaccttaacttcatattccctttaaggcactaatcttggtcaagcttcaggttccacggaaaaagtgccaagtgcaaaagaacacgtgtaactgctgtgtgacttttgccttgggaaaagtcccttaaagaggcaatatacagaaatgccttaagtggaaaagcagggcaacctacagaaggtattaggacagtaaaagaagttctttgtttaggcaagatttttttaaccaaaaaagtgagaatgtaaaccttattgctttcagttggaggacagctggcaggaggctgattcagctaacattggggtttaaaggaaattggcaggagactcaggcagatgtggtttgaatacttccctaaaaggattaggctgagtcacaaaaagaagtataaaatggagaggaaggaatttggggtcttaatccaaattctgtcactgactgttacttagggtttccaaacgccatatgcccagctcagtgctttgaaaatatgtctccactgtaaacctcatctgatagggaaaaaaaatgaggatcagaaaagttgtataaatatgagtgatgatgccaagatcataacatgcatttctcaagttatcaaactcaccctttcttaatcattgctggaaaatttccatatagcattcttttacaggtagagacaaaaatatcaacatgaaagagtaacatcaaatagttgctcaagagattaaaagacttttttctctctttgcagggcagttgaggcataagactactgcatcaaagaagtgagtaacatcttaattttcacctgttataattttctgtgaaatagcaaaatggtctctacttaaatgtttttcacatattatattttaaaatgtgttgctagaagggcatataatttattctattaacactttcaagtgaaataaacatgctataattctacttaaaggtattaaggtaacattttcacatatttcattttgaggacttcatttaattgaagtaagttgggaagaaaaataagtaacactagaaaactgcattgggtcttaagatttgcttttttaaatcaggaaataaatgcaactacatctctgattaagaataaacattctctctaaagcccccaaaatccctttattatatgttaaaatcttggaagggtctgaacttcattaagaaaaaaatgtaagaagcaactattagaataaatattattctttatctttctcatctctatactgattgctatcaacatgcagtacttaattttaacattctgatatacagcattataaatgtgcaacccaattacagaaacactgataggaatgaatattacatattattcataaaatagagatttggaaataagaatatatttcttcatggaagcaatgttatatataaccatgtgatcccatgccaaattgtaaaggccacttaagccatgatatggttaaaacttagctttaaaatacctaattactaagtaaaatactgattatacacaacacatggagaattatgggttttaggagcagagtagccctatcccctgtccataaatgcagcagaaagaggaaaaaggaaataaggcatctctgagtcctggaaattatactccagagagattcatccaaaaaagaagaaaaacaagtaaaaaaaaaaaaaaaaaaaagcttgtcaaaaaattctagttatcagggccaggcgcggtggctcacgcttctaatctcagcactttgggaggctgaggcaggcagatcatgaggtcaggagtttgagaccagcctggccagcatggtgaaaccccgtctctactaaaaatacaaaaaattagccaggcatggtggcatgcacctgtggtcccagcaacttgggaggctgagacaggagaattgcttgaacccggcagtcggaggttgcagtgagctgagatcgcatcactgcactccagcctggatgacagagtgagactctgtctccaaaaaaaaaacaaaaaacttatagtaatcctgatgggaacatttataagtcagactttctaagtcagagacagataacactccacacagagaactcttgaactcttgatattttctgcacagtatggaagctattggacaagaagcctttacagacaaggttttttttttaaggcctactgacaagtacaatgcacacttttaccagtcttgtaaaactattttaaaaaccagatggtataggaatggaaataaatagatctctttaaaaaaatataattttggcaataatatacgtttcaaagggcaatgtaaaaattctgtttcaaatcacctctacatgggtcactaagatactttaacagtaacttatgccaaataaaaacttattaaaaaataaaaccccgaaagttaataactaagatttctattctttctaaagactgtagatttgttaaatgtttcaattgttagtctattcgataagagttgggattttgttcagtggctctcaactgagggtagttttgccccgcaggagacatttggcaatgtctgaaagcattttgcttgtcacaattgggggaagattactacatttatttagtaggttatataagttttcataacaaattaccacaaattaggtgtcataacaaatgactacaaatttggtggcaaaaacaacaaaagtgtattctttcacagttctggaggccaggagtctgaaatcaaggtgttggcaggaccttcctcctctgaactcttgagtgaagaatccttccttgcctctgcctagcatctgggagttgctggcaaccttggcattccttggctgttggtagctgcattagtccaatatctgcctctgtctttacatgatcatcctccctctgtatatgtctctgtctctgttcaaatctccttctcctttttttataaagaccagtcattaggtttagggcttactctaatttagtatgaccttattttagttcattacatctgcaaagaccctactcccaaataaggtcactttcacaggtacccaagatcagggattaaacatatctttttggggtgtacaattcacccaccgcatatgtagaggccagggatactgctaaacattttaggataacagcttgccacgacaaagaattatccagcggaaaatgccaacagtaccaaagttgaaaaccttgattttgaacagatacatcagcaatactgattcttcaatgtgatcattcttaataatcttccaatggccctgtggccctaaattcctgttctgcatagtttaggtgcagacatttttaaagtgtgaacattttttgccacccttctctcccaagaacaccctcctgccaggggcctattttgaggactttttatgaagaaaaaccacatgctggagggacgctgaaatgcaaaccaggaaaacagttatagctattagctatctcattgcttttggctaagttacaaaagcactttgggcttcaagatcaatgaaacaaggtatctaaattccctttcaggttctcagaagtatataattgcaaggctattaaaagcttctggtttgggattagggacacattagtacaataacctcaataacttcaaaaatgccaggaaaatgctattttcaaagaaaagaataacaactctttaaaggtaacattcataatttctattctaacattatttgagatgttctatgtttaaatagtggcaatttttattaggagtagagtttatttttagcaaagtgttgtgaggtttgttctcctacatcagcatatatgtcataagttattaatttctaacgttcaccttatattgtgccatatgtgagaccagctgtacaaagttaatgtgaaaagattacactttagaacaaatagcctcaacacatgtgatttgtttctgttggagggcatatacacctttggaaaatgatacctaagaacattaacagatttctcaactactgttttagtttaatacctcggtaaactgaagctttctcaggtaaactaattatttttgtttcttttcaaacaatctcaaagtagcagaaacatttcaagaacagaacattttcccctctgaaccatatgagtaagtttctgacctgatgcttcatgccccactaaaacattaccgtctatttcctacaaaggacattccccataccatcacaatacaaccattaaaatcaagaaatgaatatatatgaagcaccatctcatccccacaccccatctaagtttcaaaaaaaagtccctataacgcacttggtagcaaaaggttccagctcagaatcacacattgccgttggctatcacttctctctaatgtggcttcactctggacctgtgacagtctcttctgacttttccataaccttgacactttttaaaattccaagacagttctgctctaatatgattatatttgaggtaggcatctttggcaggaagatcatagaagtgatgctgtgctcttctcaccagatcgtctcagatggcataccatttttttggtctttgatcatttgatcaaagtgctgtctgccaagcttctccactataaagttactctttttcccttgatattagtaagcatattctgaagagttactttgaatctttagtactttgtaccccatcaaagttttcattgatttattttttaatttgcttcagttggtactcatgaatccccatattattaaatgggttacaatccactaatattattatttattttgatgctcaattttgtcccagatttgtccagtgggaaccccttcatattggctcctgtatctttttgacatgactcattatcctttgagcactccattgctttctggcacaagatgttctaggcttatctgctactttcccacactagccctgaaatcagccatttctccaagaagccttggttactattagtaaagaatggtatttagaacccaagatctgggtgctaagtatactcatcactactggaaatcactgctaagaatacatgtgcacatattcatatacacatacaacttataatgtatatcatatacacttatgtatatgatatgcatgatacgtattcatcatacatatatttacacatatacttgtttaaagctatatacctatatagacttaagtaaagagatagggatttaatgtcatggattcccatggatactgccaactgcaatccaacaccacagggttcattctactttttctctatctttatttcattcttctctagtgaaaaacctagatcctattatctttcctagatttaattatttgatccatcaccctgtatactgctaaactgtcattgctactgccacacctgtccccacagagatgtctccttacccactcaggctccaacctccatcgctggtctgaccctcctacatgctttcctccacatcttgtttgggatcaaacatcacccatctgctgctcctgcacaaaagccttgttaaacttgctcaactctgggatcctgtgtcaagctgcccgctgcaggagcaaccattcactgtgctcaggccctaatactccacaccaggctgccctcctgcctgatgccatccttaccagggtcagcctcagatatcctgatctggtccccttgggctccacccacttagtgaggatgtctccttgctcttccccaccaaataactataggacctatggagggaaagatgagaggtaggagggaagggaacgagggtgacagaagatgaggaagagtcagttgccctaattcttaacaaatgttttcaacatataatttttttgtgatgataaatttagggtaaaaatggtcatgcatcagaaacatcactattaaaagtaggcttaggctgggcaccgtagctctcgcctataatcccaacactttgggaggctgaggcaggaagatcgcttgagcctaggagttcaaggccagcctaggcaacctagtgaaaccccatctctacaaaaaatacaaaaattagccgggtgtggtggcatatgcctgtagtcccagccatgtgggaggctgaagtgggaggatctcttgagcccagaaggtcaaggctgccctgagccatgagtgtgcctcggtactccagcctgagtgacagagtgagaccctgtctcaaaaattaaatgaatgaatgaatgaataaataaataaaagtaggcttatggttcatctgttccatttaaacagattttggtctttgatcatttgatcaaagtgctgtctgccaagcttctccaccataaagttactctttttcccttgatattaatgagcacattctgaagagttactctgaatctttaatactttgtaccccatcaaacttttcattgactcctttttaaatttacatcagtgggtactcatgaattcccatattattaaatgagttgcaatccactaatatcattatttatttgatgctcaatttgtcccagatttgtccagtgggaacccctttaaatgtccttaaaggtaaaaactgccagcatgttctactgagatatggactaacaatgtcagacatatgtgggtgcttgaatagtatttgcttcaaaaatatttattactagaaagctgctgtgtttggggtgagaggttagtagggaagggggttcataaagggaatgcaaaagccacgtcctctggaagttaaaaggatcattttaaatgattctactgcaaacatttttcaaaagataaacatgacccatttctccaatttgtgtcatgtaatagtaataataatgatatttaaatactcccactgatatatcctttacaaagatatattatatgtcttatttaatcaaaaaaccttaaaacagtccctgtacctaattttattccaggactcaaactgtgtcagcatgtcattcagtgcaaatcagacatttagatgcataggctatgctgtcagtagttctgaactttcatagacatttccaattagctcggagagacaactggatattgtgtttaagcactgtgtttaggaaaacaggcactggatggaccaatgccaaatttcctgctctgctgcttaactaagtatgtgtaattacttgggcaattaagcaattacttgggcaattacataagccaagccccaatttcttcatcttgagcccagaaggtcaaggctgcagtgagccgtgaatgtgcctctgccctccagcctgagcgacagagtgagaattccccaggagtgcagaggttctcagaactgcaatactctgagatgaattttgaaaggtgaatcagggatagaagaattagggatacccagaaaggagaaaaatgttctagacaattcttttttcttttttcagctggaactaaaaaaatgctaactcatagggctatacatttataactattcttattattaaaatttgactcaaagtcttaggttaacagacaacctgtgtctaagtatgtaggcctatacatctaggtcaaaaatatccagtaaacctcacaatatcctttggcaaagagaaaaatgaatttcccagagatcaataccgaatctagaaaacaagctgagagtgcctgacaatttttaattctggcttaaattcgatgctaacttcataacttttgtcttgtacattattccacaattttagcttacgtggagctaaaagagcagaacttataccatatacatagagtgacatcccctcccccattcatcttattgatttacaccttcatttattccactttcatttgtttcctacctttttttttttttttcctttagagatcttctctgcatatcaacttaaccctgacgcctatggaataagtatttacctaacagtgcactgtctaggccatatcattttaaagctgtggtttttaaccagcttaaaatcacatttaaagctacatggagagctgatgaaactccttaatgcccacactgaatcccaagccaaatgaaccagagttttgcgggaaaagatccaggtatcaggatttttcaagctctctggtgattctgacatacagtcaagtagagaatcaaagttctacaatgaatccagaatgcactggttctcagaactgcaatactctgaggtgaaccagggatagaagaattggagatacccagaagggggaaaaatgtcctggacaattctgtttctttttctttctttttttttgagacagttttgcactgtcacccaggctggagcttagtggcaccatcaccatcatagctcactgcagcctcaaactttggactgaagcaatctttctgccttggcatcccaagcacctgggactactggtgtacatcaccacaaccgcacttttaatttttttttttttttttttaataaagaagggaccttgctatgttgcccggggtggtcttgaactcctggattccagccatcctcccacctcagcgcccaaaagtgctgggattacaggcctggacaattctttataagtggtattatggaaaagagatgtggcacaaggaaatctgcgaaggaacccacgatgttctgtccaagttgttaacaactagacgttttaaaaggcatttataaaaattaatagtcttaccttttgattatccttccttctctatggtgtgttacaaaaattccacatcttacaagcccatgaaaataaattcccatgagagtttgaaaactttttgcagaataatgtcccaattttagttactggtggccaatatttaccagcttgagaggtggtcttttattacccttactggctggtaacatttatgacacagaaacttgcaataggttggatggaatcctttcaatatgaaaagtaattataaacaggtgaaggtagaatggcaactttcgtgttggctttgttaatgttttgcacgtaatccctctgtcaaagtgtcttaaacaataaaacaacaagcaaaaatctcacacatacacacacacacatgcacacacacattttgttttcaaagaccacggtgtaaaatgaagatacacacacgttatcctgtaagttgtggatctttggttggctagttggttatgatgttttttcccctactcagctctaaaaaaacatcctcggcaaggtgaggtggctcacgcctgtaatcccagcactttgggaggccgaagcgggcggatcacctcaggttgggagttcgagaccagactgaccaatgtggagaagcccagtctctactaaaaatataaaattagcccggcgtggtggcgcatgcctgtaatcccagctactctggaggctgacagaggagaatcgcttgaacccgggaggaggaggttgcggtgagccgagatcacgccattgcactccagcctgggcaacaagagtaaaactccgtctcaaaaaaaaaaaaaaaaaaaaaaaaaaaatcctcaaagccaacccacctgccaagaggagggaaggaggtgatactcgagccttactctcgaatcaagaaaagggagtaggccttggggaaatgtggctttcaaaattcatgccatatttgcccaagccaagtcgctagctggtccctgcaaccacccacacaccccactgccttcttcctaggaaaaaccagactctgccctgttacctacgcgcccgactcgcggggcgctgttcgttcaagactcgccccaaagagcgcaggaacgcgagccgcagcagtttcagggttcagcttaggtgacacaaacgtagctaatgggaggccgccgccgactctcccacccgcccttaccagcatccccgcgcctctccccgccacccttgcccggcgcgccggcgatgccctctgcccgcggggacccgagcctcgcgcgccctccgccctccctaccctggaccctgtacccatcacacctggggcactgccgtccgccgagcttgggcgcgcggcagcgagaaggcactggaggaggagcagccggggcgtacgcgccctggcctccagcaggccggggagggcgcgcatggcgccagagggtccgcctgggtcctcgtggagactgctccctcagctcgccgccgcgggtgtccagagtccctgcgcacactcgcaggtggcccggcgctcgcagccagtgccgcgggtaggacgctgaagaaaaggcggaatgggaggggcccggccgccttgccccactcccccgagacgctcttaccgcgcccggccctccatcagttatgcagccctcagccggctgctggcgttcccggatgt

SEQ ID NO: 223 - DNA, 442486 bp, Homo sapiens
aactccacctgtgccttcctgggaaactaccaccagtttcaaatctcaataagatgttagtttcacaggaaatgtggagctgaacaaagaaatgatgagtatgcttggccaaactatgcagcactatattaatatttctttgctaaattttttataaaataaacaaataagccgattttttaaagtaaatataaggatatgtaattaccatctaaatgaagatttaaatttaaagagacatatatattttttgttcttttgtgcaaactgagagtatgggattctttatgaagcaattatttggaaattaaatagttatggcttccttcaaaaataaaactgcagatttaattaacgaatattaaatacagatcaatctactgataggcagtcatgttctacatatatgagtaaacatgacacttcttttagtcaactaataggaaattcaattagaaaaaaattgaattattcaggtaatatacaatattaagaatgtagaatagaactaaaagaaaaagaagtcacataatctcttattagaaataatgaaagtaaaatgagaattataatatcagtactgcatgttacatattcttctttaaaattttgtaataaacattgacagtgtttggtaggcacagggaaacaggataacgtagagtcattacagaagaaaaaaacttattgctaacattgcagtattccttttatcagaattaggtgagtattgattgtaaaagctctatcaactcttgctcttatttgatgactttgagacttttttactcttgctataaaaagaaggctactttctttccctaatatatttctaccaatgcgaataattcaggaaacaatgagagaaaagtaattcacacttaatgtgttgttacttaagagatttgacggataaaataaaatcaaattaaatcattgaaaaggcaggcttagacccccttaaaaacaccgttagttgcctaccataatttgagcactttttcatgaaaaaaaaaaaaaaaccattcagtttcctacagattttgcacagttcattccatggagatacttttagggaaatagggaagagggttgtgaaatgtagcctcccctcattcctcctctgtgcagcccagcagctctgaccgcaatgtgatcctcccgtaccaggaccaaggaaggattcttatgtgtcgtgcatagatgggagggtcgatgacattttttctgtgagtgtcattgtcaaaatttccctggaaaacctaataaagaagagcagaaaaatgtcagtcacacagccttctttctttgaaattatttttatgttcctgtttggaacattttccccaaacatgatatttgataactattcattttcttttcttcaaaatatattgcagcttctttttaataataattattttaaattaaatggtcaattaatgtttaaagagttaaacctttattgtttaatgcagacattcataggtctatcattttcctctacttgtttctctcaattaaaaaaaatacaacaggtattcattttttgcttatgtcacaggctgacgttagtcatgtagcttgctgaagatgctctcttccacggggtgactcagagatccaagctgcttgcaaagtacagctatcatctggagcaggcggcctccacattcacaaggggcaaggggagggagagttagcagactgtgcagagtgtttaagagaacaagcatggaagcagcttatatcacttctgtatatatctgtttcaccttacctaattatatgactccagcctaacagcaaaggaggctgggcactggagagaagcacaaggctatctggtgagcactaacggcctctatcacagtgccttttgcccacttcttctcacatagagaataaaactagcccatctccaaatgagacaacacaatcaatgctgtttttgaactgtttttctcttcttttttggcttcatctattaattcctggatccatacaatactattgggatgaatatgacttataatatcctgaccctttgcattgcacgtctattcttctttcttcttttgtaaaaatgcttttttttttttttttttggagctttactattactatggccacttgctcttccccaaaagactttcataataacttggacaaatgtctgcttcagaaaacaaaacaaatttaaaacactgggtccctgataggaatggcattaaattataaattatgttggggtaaactgaggtatttatattatttagtctttatctgaagattttatcctttttttcttatagattctgaacatttcttattaaagtgatttctaactattttatatctacatttttaaaaatttagatttagtttagatttttagatttagtttaaatttttagagtaaaaatctcttcaacgctttctgtttttgctttatgaagcatcttataattagaagataattttctttcttgtttgacatcaaatttctttcttgtttggcatcaaaacataactatgtggccagagacacctgaagataaaatccttaaagtagaaaacaaaaaacaaccaaactccatcatcacatgacaggatacttaacccacatctttcagcattctgaaattaaagggaatgttttaaaagccttctaggctagattggttcagtcttatacggccacaaatgttctcctggaaagaaaaaaatcatattctcctcaaaagcattaggcagtacggcactgattaataggagcaatagacaagactgaaaagtctctctgctggttctgctggcatatctaaattcatattcatttagcaggcattttatgcttagtaatgccctgtcttgcacaaaggaataattcattctggactgaaatgtgctactactatgttacaatgtctctgttagcaaaactcacaggtacaggacatatcataaacactcaccaaaaatcttgagagactgttgctactgcaacagcagaaaataagccctggtttactgacatcctctctgacatatgatgttggattcaaatatttcactgagattgtggtattacaatttaatacggaatctaaaatccaattttgtagccctgctagtgaacttaatgtatatctctgggataatagagtttaaattcattaactttcattgcaagatttataacagcccgaaatatagttttataccacttcttgggaaggaaatacagaaagaaacaattttctcttaagtgtctgctctccagcacaggttttgatgcgaactatcaacccagaaagtattagttgaattattaattatacttatttctttataatgaagaatacatacagagaaactatatcagctctggaactgaaaacaactatgaaatttctgatttaatatgtgaaagtcatggatatttgcatgttcacttaaaaaaagtgaagtttcacgaaacaggatgattaataaaacaataacgttcacagaaaaacagccgaaatctatactagaatcacagaatttacagcctcaaagtactgaaaatatatttttattttcagaggcctctcagtaatgacacgtacagaacacaaagcacccacttgctaattccaggatgatattttgtacttgttgtgtaaacatgtggcacatgtgctgttttcttatctcaagcactaggaagcccctgcttaagaatgccacctaaatatttcaccttgcaaaggaatgcaaacacagtatttttagttaacttcataaaatctctaagatttctagaaagtgctttcacaggcacattttagagacataagcatctgaactaaaactgaagtctgaaaagactgatagagaacattaaatctctatataggagtgaaaatattttacatgagaaagacacagttcaatttagaattttttagaaaaactatgcacaagttccagttcaggaaggaggctaattggctgatcacaaatttgctgatatattcaaacatgatattgcttagaggtctctcaggctttttctaacatatggggccttgatcaaaaaacactcaaggtactttgcagaagcttccataattacaacctaagagaagataagagaaagaaaaatacaactccctcaatgtagctatcttgattttctttttcctaaggttaactctcttgtgatgctggttgaaaatacaaatcagattcttcagaggattcaaatctcagcacggagagaatatcagataaaataaaacaataaaatcttgtttctagcagcattaatacattttttataagacgagctaccattctttgttaggactacggtctattcaggccggtatagacatcaataggaggcctccagggatcatggaacaaagtaacattatcctccacgatgtagtcagagaggtggggcatatttcagtttcttttagcagtcatcgaataggactctaaatatcaaagaatcccttggggacttcttgcacatatgatttctttagaaaattatctagtttgtaaaaatgtgcttcttttcatttgtcctaaacttaactgattaaaagttttaaagagattaccattgttctaactttttggaattgctgttcacatcattcaaatagcgagtggttctaagcatttttagatagattccctatggctaaacatcagcattttacatcagtattaaacaccagtattttattaagatttcaagtgaccatcacttcatccctctgggtttttgttgcccccttatagatttcattatttttcttctgctatttggagactatagtcgaaccgcatctgggatttcagatattgtggaaatataaaggttgagtgagactttctaaagttttttctattgattgtatttgctttgtttatggtatcaagcataccactggccttactgactgtatctgtacactgacctgctgttcttaagggatagaggacaaaggtaaagatccattttcctagggcagcatgtatgtgtctgtgtctgtgtctgtgtgtgtgtgtgtgtgtgtgtgtgtgtgtgtgtgcagaggtgctgggctgaaagctcagaattctttatttaacatacataatttcaatcctttgagctttcatccagagcactaatggagaagttaaataagaacagtctttggtagctctgatcctcagaaaccctgtttttatctaattctacccatataatgaaagaatctgagatctggaagagaactcagagatctgctatcaataacttttccctctaatatttctaacatggaactttcagcctattcatggcatgcctcaatacaataggacaggtatgtatttagacagtttgaaagtctatctttttagaagactaaaatgtgtatctctcacttcagtctattgaatctagtgcttaattctcaatgaatatagaacaaacttagctcatcaaaagaacttttgacatacttaacaataattgacacaaacctctcaaaaactcaacttcagcgctctaggctaaacattcatagttccttaaaaagttcctcatgttgcatgattttcagacttataatcttgattgcattccattgactaacatctgttttaactatggctcagtgaaagcgtggtatttattgggacacagaatgtagacatactgtgaataactcaaaagatagagtgcgcctttgttgtagatgcaatatttctatcaatgcagtctaaaatgtagaataattatattgcattttgggttatagttgattgatttatggtcaaatagattttggatattttcataatttctcctcagtgagggttttccaattttttttacttgtatctgttttataaagcaaccatttatatattatataagtatataattctgatttttgtggctgacataagggacagatgcttattaatttatagttcaggatcataaaatttatttttatatacttagtgtcaacattacttcaatttttttgactgtcaaaaatttcagagttacaacttgaatcaacgctttaagtgatgtaaagtcttatgaaaattttcacggaattagtatgcatgaatcacgtcaaacataacatttttccatttgaacagtttgggaaagagctttctttgtttctaattctagggctagattttcagtaatattttaggataatctaaaatttatgttctactttgccctatatgcaagcattccaaaaatcaaattttttttattaaaaaggaaaaaaatatcaaaatatatagaaaattatttttaaacattttagttagtggtatacatctatatcatattaaacaaatcttattggaagctttgcatgtatgaaacttctataagtgattggctataaaaagtctgaaaccaaagtttaattcttttagccaaaatagactgcagctatcattctgtgaattcaattttctaggaaaatttaccagcatcctgaaaccatttcatgattgaatggctagtatattattcttgatgtttttctctgcaatcaattccactaaaccaatgaaactctgtaacaaaattagcctcaatatgagtacattcttccggatgtaataaggaaacaagaaattcatttccagataaatttcaatattctaagaaatgtttctttggaaaatagtgatattgagaattatattctaagagggtcaccaaaaaagtaggggtttctgttggagccagtagactttgttaataagtgtctatattgatcatcagtctgcagaatgagctgggggatcagccttcactacagggcagcccaacaacactacagcacaaattgtcattgacagaaaggaacagagagctaccacagtgtcttccatcccatagcatcctgagtggaaccattaccctccaaagctgaaataaggtcataactaaccgaaacaatttatcagcaggtgaaagtcaaatgaaaaaaaattcaaccaaaatgtatacataagaccttaaagtagagccaaagacaatgataaagttacatgtcccagtttgtgaaaatataatgtgtgtaatctacagataagagatcaaatgcgaagaggacttgttttcatatcaaccactaattgtaacatattagacaatcactttatttttctgtatccaaaaggagttgatcatcttgtcttctttgcaagaaacatatctagacacatcttaatcttgagtttgcttgtgtgtactatcttgaagtaaattgctgaccatcatatcttttttctattgaacagttcttctgcagagtttaggatgtgtcaaatctagtgtaagcatagcgtttacagacacatgtcattccagtgatcagtgtacagtctacaaaaccgtgtgtaatacgagtgtgcagtagatgttaaccttacccaaggaggagtctgtttttcaccctcagcaacttgaaggtaatctctaagcccttggaatggcctgtctgagaagagtatttttgtttcccagggggctctgggccacaccagatagcctatgctaacattgtggtttacagtggggtcttcaggtcagcttgaccactgaaaaggaggaaactaaggttagccatacagatggtcaaccatgtctaaatgtaggagcttccacaaaaactctgaataccaacgctaaggtgagcttcctagttggcaatactctgggcttactgtcacgtaacattgctgagagaacttactactctccagaagtctccaagacaactgaaagctcattcctggactctcctggactctgccccatatgtctcttcccttagatgatctgtatccatatcctttcatcgtgataaacgataactgtatgataattttagttgtgtttgtgagtttttctattgaattatcaaacctgagaatgatcttggggaactgtgaatgtgcaattgatgtcaaaagtgagggtgggtttagggaatcctgaatttgtgatgagtaattggtattgaagggctacaggtttcatctaagttttgttgtctgaaacattgacagttggaaaaggaacctcaattgtctgaaagggttgtatctacaacttccccaacatcatgcgccagcgtgtgacagacattcaggctttaaagttgattgtgaacttactttctattctgattctttgaataaatcctcaaaggacaatccattgaaatttgtttattttggcccataagtatactttctaaactttctactgttaggttctactctctctattttacttgctgttcttattttcaatttctggatgatatttattctcatgggcataaacctaataagcatatcaaacaaccagtgttacttgtcctcttgcatatttcagtaacaaaaaatccaacttctttattctcctgtatttctttaatatcatttccataaaagcttataggtcctttgagaaatactactttgtccatctacttgggtttcttttgaaatcccttaagaaactgcagtcagattttcttaaagctatcgtgcatggtcatatatataataattctgcaccataattcatattggatattaattttatctatgttctttttaaaatgatgttttgttccataaaccctttgaaaaatctagaccctgtttgcttcagagacttctttgcttcccaagatttctccatgaaactacctgaggctttcaaactgcttatttaacttcaaaaatctaattatagaacatttttgcttgatgggagaagtgaaaaacaaaacatggggcaggttccatagtctctctttcacacgggcatgatccatttaaaccattaaaatgaatatatgggttctctaaaaaaattatttccattcccattgttgctctcaagaaatttcttgtggctctaaagtttgctttctattgtaactatgtaaaaaagtagatttttggcttcaagaaatactatactttactgaatgaatctggctttgcttcatgttcctcatgtatataaatctctgattatagcccaagaaattctttactacaccacaaatttgatgttcacttacaattcttgtagcatgatttgcactctactgctccttctgttagattttttttttctgaaaatgcacaaatgaaagattccaataataattggccaaaacataggcaaaggtgtttttttccctaccctggcaataaaagtccacatttccggcccttcattgcttctcaaattgccagattctctttggtttccatgtagttgacatgaaagctggtttgggaacatatttcttcattgggaaagagaactgtgtgatagctttctaaaattcattatttcttagatcctctggaatttgagagtattggaaaagaggaggaaatagcacatttttgatagtattttttttagaacatttaacttctggcttttcgtagaagagttcaactgctcctaaaaagatatgggattagggaatcctattctgcccagtagtatcaacttgtctattactggcaagctggcataggcaatacttgtgattccctagtccactgtgagagtgacaagttgagctaggaattgccaacatcccagtcagcccgatgagagaccaaagggactggggcagagtggccatctccattcattctacggactgttttcttgcataactttggctttaagtagctggagagctggtagctctttagaaagagccccaagagcctcactaagaagttcatgttaccttttgttattaggtcttgaccttgggaaaaagacgtagtgaaaaatcaaagcaaaagagtccatcctccttgactgttaccttcctttccccaagcttgctgtcatttagaatgtagagtctaaaagccagtaggtaggatacaccaccatatttaacttcttttatgatgaaagtctccttaagtaatgacaatatcttaggaaatatatcacataggatgattgcctataaagatttatgaaacataaaatatgccattctaaactgtggctatatatttaaactatctgccttccactactcagattttgactgccataagaaatattcccacagaaaaagtagaattgggaaaccatctgcttttcaaagacatctccaggagatattaccaggaatagttggaaagtaagggcatctacttttttctttttagtagaacatgagaaatgtagaaatgcctttcctcttttctataaaagtacagagcaacttgcctctctattgaagctcaaaactcatctctcaaactctcatctgaaatcacactatgtattttccatctcatcagaacaatttgagactctacccctgactctacccttcatggtagatatataaatgatgtggcagtagagaaattggtgtatttggtaattcttcccgcattaggagacttttcctcacttcaagtctcattgaagagtttcaccctatccttgtcagaaatgacttaatatcgagctctatgtatgaacacagaagtgatttaagcactcagccatgtgacttctaagccagactcatgatgaggggaaaagagtattagggagaggagacaatcctggagatggatgcaggggtggcaaagtggaatcgtacagctgaagcagggtgcctaggtgtgagcgtaagcatgtattgcctaggcacagaaagtagtcattctcctttatcctctctcctgagtatcctcagtagaccatctggtccagctacaagacatagaagatcttaactggaaacaaggttgcaagatcaaatattttgaatatacttatactaaagaatgtatcatttatctgaatttaagtttaactaggtgtcagtatttttatttgccaaatctggcaacactatatgaagaacatgaggaatgctagacctaagctgagcagtcactaactcttctttgggataagctaaattttgggtcttttttcttttcttaatgagttgagggcatattattattaaaatatgcttgatctcagaagagaaaagtaaactttgctattacttatggctattggggtattaccaaaaagaagaaaagaaataaaagtgcaattttgttatgtaaaagttatattattttcactcatatatgaggaatgtcttcctttaattattattaaatatcagacatttcatttatctgttcaaaattgatgttgtttctaactttactggaaatgaggaaattagttcttgtgttcagttttctgagtttggtcctctgctcacagcttcagaaaaaccgagaggactgcctcttcacacaggtataataactgaatccatctttggttaaagttattttttaagcagttttgtgtctcaaattatgccagaagttttttgatgatgagaaatgtgttgcctctgtaataagtgtccccacacggcttattacaggtgtatttgtcccaagagtgctctattcatattaacacactttctctttgagattcaaccaaaggaactacgtaaaaatcattgccaaatgattaactttatagggagtggcagattcagaaatctttttatagtttcccataaacatggatatatgacaggtatcatttgttctttttcagatttaaactgtgaaaaagtagaaaaatactgccacattaattaagacattgtgaaactgttaagggggagacttttaattgcttaacatattgcagctgatggtgtgatggtggatagtaaaaatggcaatatgtatcatgtagaactaaagtccttgagcatttttttttatcatataataaacaatcaaaatattagttgtttggtgattatttagaaataaaatgggttgaaatttttgctatattctaattgatatagtttggatatttgtcccctccaaatctcatgtcaaaatgcgatcctcaatgttggagctgtagcctagggggaggtgctgggtcatgggggcagatccctcttgtatggcttggtgccctccctattgtattgaatgagttcttgctctattagttcacagaagagctggttgttaaaaaataatgtgtcaccttatcctctctctcttgctccctctcttgccacgtgatgagccttctccctccttgacttccatcatgagtaaaaaaagcttcctgatgcctcaccagaagccaagcagattctgttgccattcttgcacagcctgtagaaccatgagccaaataaacctcctttctttataaattacccagtcttaggcattccttaatcgtaacacaaaatggactaacaccactagtcaatggttactgcatacttaaactatcaaaataatgacatagtttctatcatactcagattgatcgagtacttgttttcctagtaggaaagaaaactatcagattcacctaaaatagcatcgtagttttttctattcaaaatgctaattttctctcagctaacatctcctgctttcatcaggttcatcactacctcttaatgaatgataacatcactgaattttaaacaatttattaaagtttgatagtcttgatcattctactggggagctaatcgctaatcaatatttttaacatgttagcatttttaatcaatgcatagagtcacagttgggctaacacttgatgatttttcttagtagttgtataagaatgacttaaataaaagcatgagtaacttttttcactgagaaatattgtcattatgcaattaggtctattaataaataagtcacacacaaacatgagatattcagaattttaagtgtacacgtttttagtgatttctgatgagtggtggaagattgagaagataaaaataggaagattttaacttttttggcatttgagcactgggaaaagtaaggtgataaagcatgtaataataaacaacatttaaattatttttcatttatgaatattttactttgataatactgctatgtaacatattccttatgttttcacacatattttttccttttttgcagaaacgtgctaactagaaaaactatattgtttcaaactttaagggagtttatcaaactccctgaaaatgtaactctgagttttggagaaaaaagataattagcaagaaaaaacaataagcatgtatttactccttattatcatattatcctgacttgttttctgctttctccataaatttattgagaacgatgtttcatagcatctgtactaggtggttatctgtcattaaataacagtcacaccagtagggacattcttcctgctccttgcccccaacccaccctaatattggtgaattttatgaattttctgcctgatgtatatttgtttctaccacctaattgttgttagacagctttctgcttttgctcttttgtcttttaacgatgaaggttaaaacatccaaatgccaacaagaaaagtaaatgattcattgtccaaaattaactgcatatttcacattgacagtgtttaatattagaaaatgtgaactaatatacaaaggattttcttagaaacctcaaaattaatccttaaagaaggacaactggctttcaattgatgtttccaaataaactgaatgacttcttaaaaaatcactgagctccttcagacagaatggcttctggttgttcctgtggctaatgagtcactctggtttgtctttcatttccagcatgtagctagttgttccattctacagttgcacttacattgggcactagccctctctctgctcatctctatcccataagccgcacctcctgttgtccccttcctttcctgctcttaaacccttctttaccctgcatccaagaacaaacatcttagttgttcttggatctaggtaggacacttgcagcttatgttaaacatggaaatggaagcataatacttttttaggagacccagggctatttgcttgtggacttgcatccatttttttctgtcttgtttttgaccccaggcctccacttcacaactgattctgataagtgggtccctattatgttctctgtgtaccttaacaactgctatcacactactcattgatgacaatatgctgctttctgaattcagtttatttaactagattgtcctttcccaactcagcaggcagatctaggcctgcaaaccactttcactttgctaagtcaattattctgtacttagatatttcctgatacatttcattcttggtcagaggccttagcaaaatttacaagcatcccattctattttgggcataccagcacatatcctagtcaggtctcataatattaaattacaagtagaaaagcagagaaacttctgaataacagttgataccaaatggtatttatttaaataacaatatccatgatgtgcttattacacattgcatgcctgtattaaaacatctcatgtaccccataaatatacatacctgtctatgtacacacacaagttaaaaatatgcaaattaaaataaataaataaataacaatgttcttatttttagacgatttgaaataatataatggtcttcttaactttagtttcaattaagtcactcagccactgaataagtaaaataaagtgactacatgaatttctatcatgtaggggcacacttcacttgctattactgaatcctagtgttttgtataaagtcatgtattttttggaaattgctttttggaaagcagcctccgttccttccttctctgccttatttgaaaagagtaacaggactctgaatggatgaaactaatggtctccatgcaatatggagtgaaaccgtccttgatcctgctgctcagaaacatgcagctgctccctcttgaaagacaattcactccctttgcttttccccctgctatcatcttcctctgtgattgccactgacaattccattttatttactccctaagggattcttcaggttctaagtttctcacccagatcaaatttcaaaagaacagcatgagtattattgactactcatctgacctctgccttacccatgagttggactttcaaggtattaaacattcaaatttaatttcagctctccaaaactactcacttcagcagaaatgacaggatgctctgtgacatctgtaattactgttgaatttgaatatatccttcaatgcagaccatggctggcagctttattaatggggactgatgatattgctgcttctatttttcacacccatgttgagaaagggaaggaggttgaaaaggaccagggactcttttcttctattggagagtgatggacttttatgaaactgacataatctatgtgctacttcttccctagagttgttttatcaaataatatacctagtaggttatattttgactttcccaaataaacggattaaatcaaaatttttccacctttactgagcttctcattagactgggagactgtgtcatattcagatttttttctcacatggaatctgccaactgaatacacagttggatgaatataaatttcacctccttctagatgatccccccatctaatctgcatcctaagctacttaaatatattatttcaatttaaaatttgtttaaagctagtgtttactttgtgattttcataagggaattggcaaacttattaaaatttaatcttatttttagaaacattgattcatattgacttcctctgaccaattagaggccaaagtcctaaagaataataataaattccattctcactagaaaaacagaaaactacacttagtttcaaaaatttaattttgtttttggcatcaattagccatttttcacacacttgcttattattagctggggcctctgtaaacatttagatttccagctcatctccagagagtctgaagcagggcccagaaatatgtatttttaaacaagctctcctcatgagtgccataatcagacaattatggtaactactgaattagagagttcaccaagatattgcagtttatttcttgatgaatatacgtgtgattcctctttaaggaccaagaaagtattattggaaacaggggattttgttttctgttttggaaaatccaggtaaagtttcaacttttcaacttatgcttttacaaaaccctggataattttagggagggagatgaaatagagtattaccagcttctttattcctgaaaaaagaaagctcctatgctgtgaattcagacttatttaaacactacgatgttatgactaatatactggatgagaaaacccatttttatttctaatttttccatataagtactcttcctgaaatttattattgctttactttggcttataacctgaaaaattaaatactgaaagtgtttgtcaagttttgcagttttcctgctaaatgcagtaaaaaacagctccaagtgtataaaacaaatgtcactttcataagagcaaaggaacatttgactttcaaataaaaatgtacctgaattaatgctgtagagaaatataaaagttagttaaatgttagaaaatgctgtagactagtaaggggaaaataaaaatgtatggactgtaatgagagtgtcatcacaggctcaattacaagagatttaatgtggaaattagctaaaaaacaatactaaagtaaactgcaattcttgtgaatgctataggagggtattcaaaaactgacatctcaattaggagaacagagtattatttttcttcagttgacttttggcatgtgtgtgtacacatgtatatttattacatatatttaaatactcctgtgtgtgtgtgggtgtgtatatatatatatacattatatacatataatatatatacgtatatatatatacggcattgcttttctgaggcttagtcactctgattaataaaaaacaaaaaggccattgatacatttttcgagttttataccacttactgtaaacctagaaaactgcatttattttcagattacttttctgaagtaatcttgtgtctggatctacattagacttccacacccaccctccaaaaatctattaaagcaagcagtcaataaaaacaaacagcacaaaagaagacttagaagcttttgtttatacatatttctgtttgaaaagtgcatctataaaacatctcacagacacatgttttgccctgaaacattcaattcatctattatatttgtctggatgaaagcttgtggttgaattggcacttgtaaatattgaagacttttttttcctcttatggagagtaatcatggaaaacaagacaaaaataatgttaagaatcaataggagatggcttactcaatgttagaaaaaattaattgctaagtagtattgagcccttttaaacagaagaggacatctataaaggatgtatgaaatgatacataaaatatctagtagaactagtaataataaagcaaaagagttattttgatacctatcaaaaacatatttcattgatatatatgtatatttacatataaaatgactacattttcaagtgtttaaataacttaggcaatacattttctcatttgttttataaaattcttttctatgtaaaaatggagagacctaatgctctgtaattccttcttccccataaaagatttccttatgataatactaattactgaatttttatctacagtttattggtgtcagttgtcttcttcaatagtaaataataaacttaggcttttatcttaggcttttcttcattatgcctaattagttacaatattaaaagcaaactggttagatttcttcttaaaactaccagttaaattggctaagtttagccaattatcatacatttataacataaaaatggtttcattaaaaaattttacattatacgaataatagtgtgctttatggtctcacaggagaattccagctcacattatttttagtaaatagtatgcatcaatctactttcacaattttccaacttgcctagtagagtctattttttcttaacaataatatttattttggttcgatgtttgaggtgatggatatcccaataacgctgatgtgatcattacacactgtatgcatgtattaaaatatcatatgtagcaccccaaatatgcacaagtatgatacatcaatttaaaaaagatttattttggtcatgtccaaattgtatgttataataattatagttcctaaatatgtagctataatctattttgcttgtgtttatggaggtaagtttctgggccttaacattcatttgaaggtggatttcaaaagtttaaaatatgtatcacaaatcctgaagcaatcacaaaaatagcaaaacgttatggctgatgattcaataaacacgattaaaatggaatcactgaaaatttgattaatctaaaagagtgcaaaaataggaataacaaaaatagatgtgacaaataggcactaaatagtaagatgataaatttaaatccaattacattaatactcccatcaaatataaattgtttaaatgctccacttgaaaagcagagatagactggacaaaagaagatcaaattatatgctgcatagaaggaatacttttcaaatattgagtacaaataggttaaaagtaaaaggatgaaaaaatactaaaaaatcatatgctaaggtagcattcataaaaagaaagctggagttaatcgatatctattaatatcacacaaaatagatttcagagcaaaaaatagtaccaggggtacagaagttcattttctaatgaaaaagggttgatttgatcaaaaggacattaaaaatctgtttatgtacatatcaacagagcttcaaaatacatcaagcaaacactgatataatggcaagaagagacaaatccataatgacagttgaaaatttccacattcctttctcagtaacagatagtacaagtagacagaaaatcagcaaagatatagaaaacctgagtaactctatcaaacgacacaaaaattttatgtaagtttcagattgagataatgaaataaaacacattaacaagaaaatgtctagtctataagaaaaattaaattactcacatatgaaatcacttttttacataaatggagacaaaaaagtatctcaacagtttaacggtttaaccataattttctttatgcttcttccctaaactaatctatataaagatttcactataatagacgtgctgtttactgaatcttacacatggataagtaaatactcatctgtcttaaaattaatttcaagcctgtataacttatgaagtttaaaaaaattcatcttatgaaacatacactgaatcagaatgcttactgtaaaaggtaaaagacaggaagtgaaatagttatttgcaataaatcatggcaaacacttgtctatagctcacaaaataagtttgaaaataattttacaaaatatctaatatttattcagtttaagacgtcattgattataaatcatgccattattttatgttcatctacgaaagaataagtgctctcaattaaattgtgatgtaagatacaccaatttctaagatgttaacatgtgaaatgtgcatgtgtcctgagatgttacatgggtgtgttctgagatgttaacatgtgactagatgtggcttttcaaatctaaagctaaaaacacatctcttctaaaataaattttgtgtgaactaaatgtagactgttgaatcacttaaacagccattacagccctagtgtttctggggaaatttataaattctctgccttgaatatttgaagaaagaaagatagtttcaacccctctgtcagttaataatgcaataaccataaggaagtaaaaggattacataacataaaaataattattaactcaaatatttaacatgtataaagcagtgttatattctcctccaaatccttcatctgagagtttttgttgatgtcttcagaaagctagcattccttgcacagtgactctaagcaacgaattaacttgatttcactaatccaactgaggccatatttaaacatctgatcccaattagtcattgataaggccttgagcactttcattctccagggtctcacagatactgaaaccaatagatactatgaaaagatgctcaaaatgctaaacattaaaaaagataaaaattgtatggcattgatttgtacagtgtgtgtgtatagaggtatgtatatataaaattcaaagtagatcataaatttaaaagaaaaataaaacaaacctatgaattaaaatacaatgaaggaaacggagcagaaaaacatctgagttttttgttgttgagctgtgtaatcaaaattgttctatttctaaaattcctacttgttacaataattaagaaaatataaatgtttaaaaataatttcattaatctttgaaatatttttctccaaagaacattttatctaacatcaggaatttattttaataatgaaaatgacagtggcatatattctagcaataactatttacatatgtattatgagaaactattcaagattctatcacctttataaactattaggtgaatcttagatagtcagatcttaggcaattaatagtatgaaaaatattatcagtaaagcaatttttttcctctaggttgcaccattgcataccagactgcaacccctttacagtactattctttaaagctttttatttaacatatattttcagtatatatggatactattttcagtacagatgtataagcagttaattcaatcaaacttgggtgtaatttgatcctccacttctgaactttataaaccgatttggctgacttaccttatcttttctttgcttttcatcctggtatacagtccagtgttctccatcattgctgtaagccagtttgtaggagccaacaaactgtacatgaccaaaatctttagctccttgtgtaatgatgccagtcactttggttggaacaagaagatccaccttaaaaaaaagaaaaatacaggctttaaatgcgacaaccaagttgtaaacttccaagtcttttgatgtcaagagaataaaactatatatatcctaaaatcaaaaatctgtctagttatttgtattttgaaaccaatgactgagtctattattggcttataattttgatattgccactgggttaatgtagtgcaagactccttgaacaaccatttttaccattttgaagtcaaatcatggtgatttcagtccaccaattaattttatattaggtggattcatctatttgtgcaggtttttttttttttttttgtaactgagatagaacagatgtggttggggtgaccttcttgagattgatcactacctgccagaactttacttatagttcaattttctgattttattggtcatttcaatgaaaataaaaatagcactgtagctgtgtccacatcagggacaaaaatagtattagattttcacaatggaacattagtcaatcctgtttccataaattttaatcaattcaataatatataattgagtaatagtaatcattgtccagtgaaaacccccttttagaaaattacaattctaaaatggttgaggaggaaggcaaatattcttcaaaaatgaagaaggattaaatatatgcattcctgacttgtagagtctatgctcataatgtgttcttttctgcaaaacacatactttaaagagcatgagacccatgaaaatttagtaagatttaaaatcatcaaaatgtaattgacatgcaaaagataggaaacattttcatcaagaatacgtaatatagaatagttcggtattttccctttttttctttaattcattcctgcattttttcacatcttatataatgttaattttttaaaaatctagaatactttgttttttatgcagacaactcttgtaagatctttgccttttatgtttatgttccttgatctacggcttcctctctcttcctgcaatagccacttacttccacctatttcctatgactaagtgccttgctacatccttgatcttatcatctttaactgtcatgatcccatgtgtgatcttggtgctttcaaccactatgtccttttgtttctatttcaggtcctctatcctgtgagatgtaaggtagccacaaatagatagtcatgggtcagatacaggccatgaatgagaagagagagctagagagaatgcatagaataaggccatatttagtgacacagatgcccatcagcaaaggtgtgaaacagtttccaatgtgtcacagcctgtgaatattcaatatttttgaattcacatgagctttttgttaactttttggagcatgtgttaaagcctttagactcaagttgcgtgatggattaggacaaaagaccacctttaatgctctatttaaacattttcaaaaatcaaattttttggctatttttctaaacatgtattatattatctaaaatgtcttgtgtgtccagcagtaatgcaggatggcaaaactatgatatcctgggaaggaaatggttgctgtctcacattgtgcaaatgttttcttctgggtcctcatttaatcctcccaataaccaaccaaggtaggatattaattccactttacagatgaataatttaatatcaagagatgtaacataatatggtgtgtgatccaaaaataaacagtgaatagagaaatatcacagattcaaatcaaaggtgcaccatagagattcttagcataacggatcagtcattgatttttgcagtaagtgattaccattgatcatttatattttctctcaatgatttctttccactctctgtgactccttcagaaatttctaaagcatcaccacactcgtcaaactgacagcaatttaagtcaaacaaaaacaatcctggattcatagtattagtaaagccctgtgttttatcatgaatttcttctctgttcttcagctgtctgggctttaaaatatagattgcttttgttgtcctaaatccaaacctaactgagcagagacagcagggcaaagctgctcttcttcaaagtgttcttaatgttgctggcactcaatacatggaaaaaaaagtcttaaagaacagagttggtgttttgctatcacaggcagtcaacatacaggaactcaaacagtgtcaccaagaatatgaaaacctccaggctgaatttcctcaggtcctaaacttctataagtccttagctaagatgatgcattgaggagttttctaacatccccttttctgcggtacttttaaaagtcagctgggtttcctgctgggtggagatgttttctccccaagttgtgtgtcttggcactttccaacagatacgtttttctcccactctaacggctccccttctgcaacattttttttttctatctagaaatgtttttcttttttgttccagttaagccaccttctccacttaaatagtcagcaatctgtttaaagctggattttgtcctaaaatttgcgacattaaacttagagtacgaggcctaagcaaaccttctttcagtacaaaaataatcagcaactcacactgaacatgaggttgctgacagagggcatgtatagaactcaccctgagaggcactcagaccacataactccagaattcgccatgtagaatgattctagaaaagcccattccttaggacctaattcttgaccctggtctaggaccgctctgccctcttgaagatcttcagggtgaaagttgagctgcaaatatgctggacaaaataccttctggtctttcagatcctcacctccccaaagtttggctaaaatagggcagactatttagggcactgagctggctcatgggtagacatttggcttcatgcactgcatgcacttcatgtctggatctgccttaaatgtgtcttatatataacaggtgctcaacaaacgttttgctgaattgagttgggactccttcttaagtatgttccatggacaagaaccagttcatggctatgaatgtcactatgtatcagagcagaaaattctagctacctttctctagtttttctatgaggatttttccttgacacagtgtcaaggaaacacagtgtcaatgtggtatccatcaatttatactgaagaaggcaagtagcaaaaaatcctctccaatcttaaggaatttgatgctaagagtcagcctactctaacggaactgggtggtttggggtaccaagttggttcaaggatcttggacatgctactttacctctctacctcccaacttcctgatctgagaaatgaggataacaattctcataggactttatgagaataagatgaggtaatatttatcgtgtgtacagaagtaggtatagcaatatataaacactatatagtaagtactatggaagactttggtaacatcatgaaattaagaaatctgagggaaaaatttaatatatgtttcagaatatcttgttagaaggaaatggatacagagaaatgggtgactagcttgttctagcaacaagttctggatcataaaatatttcgctcaccatctcaggatatatacaaaaatagttattttacctttacttaaagtagacaaattttgaaaaacctgaaattcccatttatgagtgaaatggttaactaaaaacaatgtaacgttctgggtatggtggctcacgcttgtaatcccagcactttgggaggccgagaggcagatggtttgagcttaggagttcaagaccagcctgggctacctggtaaaaccccacctctacaaaaattacaaaaactagctgggtgtggtggcatacacctgtagtcccagctacttgggaggttgaggtggcaggagggcttgagcctgggaggtggaggtttcagcaagctgagactgtgccactgtactccagcctgggcaacagagccagacatcatctcaaaataaataaaataaataaaacaacaaattttatatattatgcatctctattttaatactgattgtgatgcaatggagatatagctttaaagtaatattaaaagagaaaatagattccaaatcttattgagttacttatttcactctaagaatgaaaacaagagggaggatacttaaggagagaggattaaatgattcaacagtaaacaaaaaagtatggcatgagagttctgtgggaatataaacttttttgttgtaaaacatcctgtaatgttttggcaaagcataaatatttttagagtgtgtctaacttagacaaatggcatagaattctgtgagcatttgtttgaggaagttaaagataaacttcatttcagacatctgcacagcaccctgatcacagctccctggaagaagatggggcagactggaaaattaagttgattttcgtgaagacattcttgaaggggtgaggacaatgaaaagtgatacagataaataagtgtgcaagaaatgtgaacacaggccagtttcatcacagaattgtgccactcagctacatctaaaatgctcttgtttgtgccttcatatcatttattctgaattgtgtattttatgacttcatagagtttgtaaaattaactcattaaacggaaatgactttgaagctaatatggttaactagcacagtatttgaaaactgacttataggcaacgtatttaataacatttggtttcgatacagaatgttttatcttaacattacacaaaacaattgtagctagtcccagttatatttaaggcacataattaatggtacttggtatttggacaatattgctagttattagatgttggctacacttgtagtccatatttgcagggcaactagttaatgtgattaataatctgaaatattcagctcctgtatctgatttgatctagttctgatctaaagtttggaatccttaaaatatgattaaggccagataacataagcattctagcactcattattgcattttcccctttactaaaaaaattttaattttcaacaacattttaagacacttaacatagcaattgcttttttcatgtaatatattaaaaatacaataactaaaaccaaaaactcataccatgaaataatctgtcaaaggatgaagttttctgttgtattggtgtgttatggtatttttttcacatgtaaaaccatgtacgacacatgtatggtgcaataaacaaatgttctaagctcaagtgatcattcagctgtgagttttgtaggacacctggcatattgtagacattccaaatatacaggcatcatctgcctgaatacaaaattgagataattttgtacttaacaattacctgcaattacaacatgaacagtgccatatgtcaatctgaactacaacttatgattgttgtcagcttataactattaatttttaaaagaatttatttagaatcatgcaagtagttcaactgcacgtttttcactgagaatgggaggtaacatgataattatgaatattttatatttaacattttaaattttaattatctttttcattatgaataagatatatgatctgtagaaaaatttattattagaaaactttaaaaacaagtctgttaccatgagatataatcaatgctttccttcccaattcaaacatgttttcagacaaatttgttgttcttggcattttaaaaaatattattggttaccagacgttggttacacttttcatccatatttgcaggcaattagtttactctttatttcttaatatttcaatagtaattatgttattaaaatatttttatattgtctattttcaatatatatgtacttatttatacctagtatgtcattttaaggagttattacaatcattaacttactattaaacatttactccctctatcctcaatttttctattaaaattaacattcccacacaatcatagtcctttcatcctgggccacatatctcttcattcctacagcacaaattcaaataattaaggctacttggtcaaaggaaatgattttaaaaataaacaaaaaaggccttttaaacataaaagaaacatacaaataatagtaattcctaatgactatataacattccgtattgtgcgtgcatgaatgaatatgaaaatttttaaccaatcccttgttgatgttcatttaatttgtttccaattcttttactatcagaagaaaaacagactcaactctcatgtgtatttatttgcccactggtgcaactgtttccttatagacactaagaacctggcatttgaaatgtgatacacattgtttcatttatcttcaggaaaattacactcttccatctgctatataaaataactctttacacaccaatcccatttttaaataaaattttacatttaaatacattttattttttaaaaaattgatacataataattgtacatatttatgaggtatctagtgatgtttccatactgcaatgtctaatgatcagatcagggtaattatcatgtctatcatttcaaacatttattatttctttttgttcagaatcctccttgtaactatttgaaaccatataatatattacagtcaactatagtcatctgacagtggtatagaaaactagaaattatttctcctatctagctgtaatcttatttcctttatcaaatctctacctaacttcccatgccctctaacttcccagtctgtagtatcctctgttctactttttacttctatgagatcaactttttttagcttctacacaagtgagaacacgtgtgcttaactttctgtatatttttgacaattgaaaagtggcatttttacctttaatctacataaatgtcactaagtggcatttaatttatattttcttaattgttcagtgtcactaattatatatatatatatatatatatatagtctctttcatgttctttgtctattacctattggattagaaatgttcctgctgatttttaagaattatttatatagtatcatatgtggtttctgttatatttgttgcattttttttctaatttgctatgtcacttaattttatttttagcacaagttttcaattttactatactcaaatgtatcaattactgttttcatgattgcatatttttgtatggctaaaaagataatttacttgattagatcagttaaatctacaattttctctgagttttcctttcaagttttattttattctttcttgcccttactgaaccatcttggttttatgtgtatacataatgtgacataggatcacagtatatatatatatatatatatatatatatatatatatatatttaagaacataattttttcaacactatttgttttataatctatttcttctttgttctatccccctacctgagtgattcttacaaggtttgcactttcttctagaaattaatagtattaatcatcatcatccaccagtatatatcttgataaaggtttcttgtattgctttggacagaacaaagttggtgcattcaagctgcagactgttttctaggagaagacatgctcaaaaggttttcttgagttatattttaaaatattgcttctgcttctttttggtgtctcattctagaaggccagttgtccaaaagctgagtttttatttctgaggtttttttttgtaatattttctcactcatccttttcatttatttattattttcctctgcattctcagagagtttctccattctgtccttaatattatagatttatttttggtaatgcaattttaacatatattttaatctatattttgaaatatatttcagggaaattggaaaaatatagcacctctcttattttctcagcattaatcttaccttctctattactcctctattatgtcataaagaaaaaaatatccttttttcttttttttttttttaaagagacagggccttgctctgtcacccaagttagagtgaagtgcatgatcataggtcattgcagcctcaaactcctaggctcaagccatcctcttgtctcagcctcctgagtagctaggggcatgcacctccatgcctggttaaccttttattttttgcagaaagtgccttgctattttgtccaggttggtgttgaactcctgacctcaagcaatcctccacccttagcctccaaaaatatttttatatatgctcttgaaatttggttgttttttttatccgtagaatatttcccacttaaaatttttttttcatacatttagaaaaatccctattcttttcttgttctgcacatttaaaaaataggacctatattatcttgttttcccttcctttacttaacttgaaatgacagagaagagtcctggtgtttgtcacatgccagtcatataagctcctctttgtcccttaccatctatcaagcagttgcaagaatttcttagactttctaccaatgcccagcagacatttaggcagtacagtttatctggtctaaagcacaagactctcctcctcttgctgttttcctctgaatatagaaaagttatttattttcttaataatccaaaatccaaagctttctgttattttttattcaatggagattttgctgagataactgaacatccattgtttatttctctattatataatttatgtattatcacaatgttgtcaatcttctcttgtcaaaatgtaaaatcacaggggcagacaacttggtctatgttatttggcatgtgcctggcctatatgtttcatgaaatatctactgaatgaacagtttcatattttaggattaagtaagctaatgcatccaatgtgtattctattcatctttgtcacatttgtattactgaaggtttactctgtctgcaaatgggaatggtggggtgttaggaagtcaagtactgactacagcaagatgtttctggttgtggcaacatgaccactgagcctctagcctgctgtgcaggctctgagtcttggccactgctgccctgattcagatgtcacagttcacacactgtagtgacaggaagacactgcccagagactgcaaagttaccaacaggcatcccaatgcacataaatttgtgcccatcatcaacaggatgatgggaagggaatgaaagcctgcagcagtcatgactcataagtggaatgagtaaaataatgtatgtgatttactcataaccataatacaggaacactaaaaatcaggtatactttatcagctccagggaaactttccaaatatagttgtcagcagtgtttgaaaaaactcaaccaggcttcactaagactccatgtatacgaatgaaagtccatccatcaagatctcattaaatttcaagtgagtttaaaagataaaaacagccaaaattataaaccttattaacaagcacatttggagttaataaaatgatattataaagattaaatataatgttcttgtattaagtcatgacatattttttaaaacttgaatttctgtcttttaaaatgagcagatctttataatatcctgtatgcattttattttgaaattgttctgaaaaaataattctcaaataattttagttataagtaactaaaattgacatcaagttaggctaattatccaatttcttcaagacctgtgtcagagagattaaagcatatttgaagaaaaatataaaacattggaaagttttaggaaaaagaatcacccttttcttactggattactgaaagtgactttctgctgagttcatcaaaaataaaatcaccctgggtgagcagaattaacatatcttccttatttgcctttcaagcctgattttgattagtctggggactttgacttattacatgaataaaaaattcagggtggtggttaattgaattagtctataattgatagggtcattattaattgattaatggagatttaatacaagtttttgatcaaagagcataatgatatccaataaagatttttcaggtactttaattacagcagtgactgcacaaataaagtagaaaacacagacaattatcagtaaataatttgcatgtgatttagaaaacaattacatacttttaagtaggacctgaaagagtttgttatttagtattttttgatagcacagtgtgaacgttgtataggtcagcattgtgtcaggatcttttggatagctaaagactcagtgagctggtgatcagacttgcaggtacttcaagtagctacaatttagttgattgtttacacgtgtaaaaactatctgaatatatctttgacaattactttactgaatataattttatgcaaagtgttgtattatgtaaagccattatataaagactggtgtttccaaacacaaaacatctatatacaaatttgtgtgtcaatatgtagaactacatgcatcttattctgtggcaaataccataagaactgaaaatataggttggtgcaaaagtaattgtggttttgaccattaaaagtaattggaaaaaccacaattacttttggaccaacttaataaaacatccgcagagtaaagtatattgtaatagcaaatcacattgcataactaagtattaggaggtccttgaaagtttggaaaactgacagaacacacaatgtatttttgtgctttgtgcttgctggaggagctatgcattttatgttgatataaaatttaaccattcttacaatttgtaaatcgtccacagagtcctttacatcattttgtttcatcagaccatgtgagcctgaattctagatttttttagtcttagttgggtatgtgcatgttttatggtgattgctttttaggctaaaacaaaaacaacaatccaaagaaacccagatgtaacttttttccctttgaccttatcaaaggaagtggaaggggcatggcctcttagaaatcaagcagaaggtaaatgcttcaaatcgctttgggaaaatgtgccatcaacgttagcagtcgaaaaacagcccaggtcagcagagagtttggaaaagattggaggggagagaagagggagatgactcagcaggaacagaattgcctgcggattctggggttaagagccactgacacagaaagtggactgccccaaaggatgacaattaaaaaaaaaatttttttgttcaaagatcagagtatacatatagtaggaataaaagggatacgaattatttccattcaaatgcatggtccgtaacactgtgagcattatatttgtataacaagggcaaagagcctccagcagatctggcagggctatctagttcctcagcatttcagtcaccataaattatacttgtagtcttagagagcctcattaaaagtcatgattatagactttctcactgaatacccataaaatcaacatgttttatctactcatatttatattaatttatttattgtgtatatatatcttatgtatattcttcttctgttattgatgctaatttccatttgctttgttctctgtagaaataaggagcagctgttgtattcttaaaactccaatctcatcaatcttttcctttaggtcctaatatctatttccttaatatagttaccaaggtcttttgagcttaataaatggtaaagtatagaaccagatgttgaatgctgataaaatctgaatatgatttaatgagtatattttaattaagtcctacagtacgatgtggcctgagtatttctatgatgaagcccaaaaaacatatatggctatagttataaagttctggcttgaatgtaaggtatataactttcataaaatattttgttcttgactgcatgtgagcaataagatgcttagactttacttcttttgagaaatggcctacatttaagggactcatatatatgcctctctcagaaattacacaagggctaatttctttctgcactcagcaccaaataaccttatattttaaaaatcacagtcttaagctctaaaactattcatgcactgtactttctattactataaaatagctcataaaccacaatcttaaattaggtatagaattaataaatcacttgaaacaaactcattatattaaacttatttttttgcatatgtattcaagattttaaaaacttctcaagttatagttcacttaactgaggactcatttgtagatttaaataaagaattttataagacacctccatctgttgaacattttttacataactgtctttgatatttgatggaaggcttcaggctcaaagctgctgacattttaaacataatttgaaaaaaatcagatgtgacatcaacaggaaatagatgtataattccttttttatatattataagtgtttaaggatcctgaattccaaagatatttttaatgaagttgaaacactgttttaaacaaaagaggaatcttgtaaaaattattagaatgacactaaaagtataatatcagaaaattaacttacagtggaaacaatcaacatggaggcatcagaacaaaaacaaataaaaaaactatcctcataaacaactcaccagatacgtctcaagcttctggcttattgtattaaaagaggttattttgacatgcctttccaattatgaataaatctgttacatttcaagaaatgctaaaatatctattaccttaggaattagaatataagctatgacataaaatttatgttaaacagaatcactataggcccaacacaaatgactcctgaaagtcttcctaagacactaagaacagaggtcacacacatatatatttatactgccagattaatactctgtattttgaaaaacatggccttgtgttgggatgcattgcttccaactcttttgtagagtagcattttctttaaaaagtaacagacaatgacataagttgtcatgttgacaatatgcttcaggaacgagaaatatccttgttgtttgggagattgaaaggtaaactgtcaagactaattctgaaataacactttttttctggaaagctttcatgtcaaacaactaatgtgctgtattttcaagagggaaataataataacaattcattaatacagcccaggcattaatgaatgtgtcaaacatttgtacactgagaatgctttttgccatagactttttagcagacacattttattaaatcaagaactttccctaatctatttatttgcaatgaaaattttaaatcatgaatgactctatcagattctatgaaattatatctcttttcatattaagataatcatgcaggtttcttttttaattaattaatacaaaaccatcacccaaccaacccgagaactgtgacatcgacaatacctatgttaaccctgtttagcctgtcctttacttctccccaccaagtatactcaatcctaaattgtttattgtgcccttgctttttaaaatataattttataattatgaatgtactcctaaataataatatttagtcttgtcataaaatttataaagaatttcatacaggaatcttctggaacttgtttctaaaactcaatattatattactaaggttcaactaaatgtttgtttataaagttactttatttttactgcaccataacattccatatatgcataaatgacaatatatttatctcttctcctgtcattagtatttgattgtttccagtttttggcttttaaaatcagtgtgaggaacgttcttatacttatcgcttggtaaagatactcaaaatttttacttgaaaatatatctaggagtaagatgtttttggttgatgagtatacgaatgtttaactttacaagataagaacaattttcaaatatggttttgccaatttgtgctaccaccatcaagatatctacatccttcagctttaatttcctaacttggtgattaccattagaagatttttttcaagtgaaaacattttatgcatttctgaaataaattttcctttactagaaaacatatttaaatgttgatgtattctatttgctaatattctattaaagacttctacatcattgttcacaaggaagattctcaatcaattttttttcttgtactctctttatccacttttggtgccaggaagtcatggtttaacaaaagaatttgcgaagcttcactctctgtcttctgtggagtagtttgtgtaacacagagaatatatgttttctgaaagctataaagtctaattcaatatctttaattataagtctattcaagattccttttctttttcccttgctttttctcttgaacatatatatgggttttcaacttctctgagtaagttttggtaatgtttcttttactataacaatttttactacattttaaatgcattggcataaagatgtttatattaaattttttctacttagtccatatttcagcctactttttcatagtgaatattttttctttctttattctcttggataattttgtcaacattttaaccatttcattagttttcttcaaagaaccaccttctaaacctagaaataaaaggcgatttcttttaatgaataacagatttcctattcacttttacagcaaaattaaatgcagggtgaaattctggaagaatctccttcaaatcagatagcaggtatcatgttccaacaacctcttgtcttaaacgctatactgaagactttatataaaacaataacaagagaaaagaaataagcatataaaatgaaataggagatacaaaattgctgctgtaagcatatgatataatagaaaaggaaaagactacaaacacactttacaatgaataagatagtttagcaaggttagttgatacaagattgttattggaaatctgtaacatttctatccactaggctcatccaaatagaaaatgtaaattttagaaacccattcactacaacgacaaatgtttttatggtattacagaatgggcatctacacagagattgaagtccttaataaaaaacaattttaacacctttgaataactcaacagaatacctaaataaatgaaaagatataacatatgtcataaatgagaagcctcaatgtaaaaaagatatcaatttactctaaaagtcagcacatttaaaaacaaaattccttcagaattttggagaaatgtgctaaactgatttgaaaatctatgtgaaaaaatgagggaccaggaaaaacctagataatttgctgcatggctagtggtggtaatagggtgaggtactattgccgcctaagattaacccttaaaataagtaaagctatacaattaaacagtgatactgttataaggatagacaagcagaaaatcataacaaaacaaagacagaaacagggtcatctgaaagcttggtatggattggaaatgagaacaacccaacggaagttggactcaataaaagatgctacagaaattggctgtttatacagaaaatgagtccttcttttcacagtatcccaaattaaatccccataggctaaatctcttaaatgtaaaaagtgaaacttcaagtatttcaggagaaaatatgaaagctagcatttgtgacatgaagtagaaagtaatttttaagcaaaacataaaaatgacacattttactatattaaaatgaaaatttccatacaactaaaacatagtaaacaaaatcaaaagaaaacatagagtctgagagaagatattcttacaaaagtcctaagaactatgataaattgttacaaaggcaaacaaacccatagaaaaattacagacaagagagacataggtaactcagagagtctgaaactctttgtaggatgagacataaatgaaaagatgagaagtttcattagtaatcacggaaatacaaattacaacagcacttagattctatttcacatcccaaacttaaaagttcaacaatactaagtgttaggtgctggcgagtagatagagcaagaataactcccaggcactgctgatgaaaatccaaattggcttaacaacttcgtaggacaaattaataatatttagtgacattgaaaatgtacacagccattgattcaggaattgcactcctagacatatttctgagataaattatcacaaggagacatatataataaacttatctgtagcattactgttttagcaaataattatgaaaagttataaagtctatgaacagaattgataactaaatgggattaaaatgggaatacaatagaattatatgtatcaacttggaaaaatctcaaaaatatattattgaacaaatatgaaaacattaatataaatgagataatacattgcagatgaatatgaacgtttatattttttaactttaaggtagcatagaaaggtacccatggtagctgcatagacattgccatcattacctttttcttctgacacagccaccaactgtcccaggacctcctggaatgaaggctagggtgaggtctagattggacatataggggctctattgcctcaatttgactcttcggaggtcaagaattctcttaccatttatgattctaatgaatacatgaaccataggttcctatgcagtagccctaatgggccgggtaacacagctcagaaatttgatgacatcaatgtcttgtagggcagactctgatcactgagaaaagaaattggaaaaaacctaatagataacattctgctcccttcccacctctcactgtaaccaataacatcaatgcacaatgaaactcttgagaccctctggagactctgagcaactcagcacctatgttttctggtgaaactgtagttagttcaattacttacaaacattttacctattttcctttctttagttctgcgttcttgctgtcctgagattgtaccatctaaaagtgtcagcttaacttgaggtgtgtgttttttttttgtttttgttttttatgggccctttggctgaaacaaccatttatagagtattgtttattatttactataaaacggcaacagaagctaaggcaattaggtaagaaaattaaataaaaggtatctggattggaaaaaagtaaatctatctttattcagatggcatgatcttgtatatagaaaatccctgtaatcccagtactttgggaggctgagatgagcagatcacaaggccaagagatcaagaccatcctggccaacatggtgaaactctgtctctaaaaatacaaaaattagctgggcctggtggcgcacacttgcagtcccagctactcgggagtctgaggcagaacaattgcttgaacctgggaggcggaggttaaagtgagctgagattgcgccactgcactgaagcctggtgaaagattgaaatatatatatatatatatatatttatatataataaatacataaataaaaattaataaaaaagaaaatcccaaagaatccactaagaaatattagaactaataaacaaattcaatgagtttgtaggaaacaagatcactatataaaagtcaactggttttctatatcctagtgatgaacgatctaaaaatgaaattaagaaaacaattctacttacagtaccactaaaaagaataaaatatgtgaggataaattcaacaaaggaaatgcaagactcatacagtaaaaactacaaaacattgttgaaagaaattaaggaagacaaataaatgaaaagatatctcatggttatggatcggaagacttagtattgttaaatggcaatactctccaaattgatctacaggttcaacatatccctaacaaaatctcaactggcttctttgcagaagctgacaaactgatcctgaaattcatatggaaattcaagaggccccaaatagccaaaacaatctcaagaaaactccacaaagtttgaggattcctactttttaatttcaaaactcactaggaagctagaaaaatcaacacactgtggtactggcatttaaatataaatatatgtgtatgtacatatgtatgtacatgtgtatacatacttggaaataagtatgtatttgaactaaaaatgggataatgttaacttttgttaaatttgagtattatatcattctctgtgtatgattacaatatttttgtaatttaataaaacagtatattgtgaactccagggatggaatgaaataatctttgtatttgtttttgcttcttaaatattcagtaggggtgaggaaggatagagtattttaaggtgtcagcctaaatttttccagttaacactgacactatatatttagtttttgtgtatgactcaaaaacactaaatccgtgaatgcaaagtaaccgatgattagccaacttctgaatatttttaaacaattctgctaccccagagtattgtaactttaggtcaagcagaaactaataacaggactgtttaaaatcaaatatctttatttttactttttgtatttcacatgacctctttttattatcattttttattattactacagccatataactaacattaagtcattcattttaaagaagactttgccatctgctagccgaattcattttgtattacttgttttcaaatttctacatttctgctgcatctggcacaaaataaatatggcaaaaaaacatgaaataacaatttaagctacaatatttcataatttatataacaaaattaggttttccaaaatggcagatagacctgctccggtatagaaactatatataattaagttatctcccatcaatgctatcatgttcttaagttttaccaaaaaaaatctaacacatgtgatttaaagatttcttaaaactatgaataacagtatcaaaatttgatgaaactaattaaaaaatatttattggcttcccaatatgttcttccactccctcccagcttttcttatatggcataatgcctaggtcagagctagatcttcaacaaattttattttgctcttatttttccattactgaatgaggccaaaattaatatatcaattaataacttaaaattaatagatctatatttcatattaatttgaaactcaaatgtaagggctctaagcatttcattaaatagcctctttctatttcctcaattattccatggcaaatctctccaatttctcctcccaggctttcctgaatactcctgtctttgttgagaattttggctgttgtctgtaaatatttcctcctttttctgagatttctaactcatatttaagggcatagcatgaggatcacatatttttgtaactccttccctggcattctctttgtagtagagttgacttctttttatatctctagaataagattaatagtaatttcgtgtataataataattttattgagtgcttattcatcactaggaagtgaaataagtattcacatgatttatctactcatcctctgagttagtttctattactgtacagtgttacaattcagggagcctcaaagaagctatgtgactttttcaagggcttgtaggtgacagaataaagattttccactcaatctatctgatgcatgtttggccactgtgctgaattgttcaggttggaccctacaaaagggctcctggtagatggggcacaagtggaagccaagcctcagtctgtattctgtttcccaaattgtacactcttgagtggctgcaacagcagcccggaggaaagagattcatttttctcatgggtctcccccagtggaggtacttttttgtaacttatttgctcgagtgaaaagcctttttataattgctttgaaggaaccatatgaactagtatgggttttagtcaggttctagaacctttgctcccaacgatcagtttatagtctctttagtatatccttccactatagtacgtatcgcattgggtttgcagtaatctgtttacaaatgcttgtccgctgctagatttcgtgctccttgagtgctccaatcatgtttctgtaatctttgcatttttaaaacttactgcaaagtctgtgtatattaggtattgaggaacatgcttattaattagataggtcgacggatgaaatgaaagagattggatcaggaacagaagttgaagtttgtttttaaaatatagcaagatcaatttttcttcataaacagcaaggaaaaattacgtgtaaatagccaaagaaatgtttgagtgaagaaaaagatctcttgagaccaaagttttaaggtggagtattaagaacttcatgttatactccatggcactgtgaatttggcagcattgtgcaatacaaactttgtcaggaaaagataaaacttaatgagaatgactttaatgccttttcagtaatgcacaatgggggaaaggtccccagattcaaagagtagtaatgagaaccaaaaactcagggacaatctgacaggtgggaggacagggactttctttttttttttttttttcactgttcattcaatctgagtttaaatcaagataaagagcatggaagtgacagccaatggcagcatacaggaataggaatgggttaacacagccaggtaagaaatggatagataaggatctaggggcaagtagaggaaactagtagaatataaagtctgatgccaatttgccaagtaagcgtcagaatcaggagactaagaaggggtatagattagattctcttgctagggctggaaaggtagtctatgcaaatctgaactcagcattgacttaagaggccaggacagaggaacaatggacacagggtaagaaagggaggctaagtcagggcagttggttcagagcgtcttgggaaacaggaagttaagaatgtctgattaaatttcagggacccaagagtgaaaaaagtcagaagagatgctacggaaagttgcagaaatgagacaagtcgagcaaggcatactatatggagtatgtgtaaaatagaatacagtgtgtgtgaaagtgaggttgtgggatagggaatataaggggttctggaaatatctggcaaaaaacaacaggtaaagctctaagtacacagactctctatatcatagagcagagacctgggcataagagtatgtcttgccagtagttggattcttttctcagcaaacactggtgaggttaaatttgggaaatggtggaatatcatccggggaatcaactggaaaaccaagtaggattgtggtccaaagaaacaaatcaatagtgcagcaattaaaagctacatacggtgacaaagagaaacagcagttctaataatgcttggctcagagtttatatggcagggctttaaatgtccactgtctaggactctgggaggtgaacctgaaagtatgcatgaagtaccctcagcattggagctggaagtttgcagagcaggaagccaggcagatcattatgttgaattctatctatgtgaaccaagatctgagggtcccgaaagacagggtgcacgggatgtcgtctgcttcaccactgttcctggcataaaatacaatccattcacactcagctctgcctaggacagcttaggtgttttgttgaaggagagggggaatgcagagcttactttcatgtataatacattatagcattaagccaggtatgctacatgcatgcacacacacgtatgcaaacatacaccacacacacacacacacacacacacaccccataaacatgcacgctgaacaagcatgatatgatttctacaatttttaaatttcctcgattctcttttcaaacactccctggattccttctttttcccattccagcctaaataaaaggaaaaatgtaggagaatggagaagactttttctgcttggtgcctctagattctttttcatgctaatcgtatgctatatttccttgcaaattgattacaccagaggaaaaaaatcacaaataagtataattaaaactgctcatgatcaatatgaggcattgcactagatttctgttctagcataatgatttctctagtttagcaagtcttggtgaggcataactgctggaaaaaaaatgtatatttttgtatcaaattttgtttggacaaatttttttaaagactctaattcttttctttgctcttgcttataaatatgaagtgtttacacttaatattttttggtgacagaatttaattgaattgaattgtggtgtctgtatgttggtgcagtgcttggaaagctgtgggaaatgggtgctgtttgtatactagagtaacaaatagggccaaacaccctctgttctaaaatttcttgcttatctctgttcctgaaatcaaatttgggtacaaagaagaaaaattcacaacttacctttgtaaaataagtaaattggccttgattttatgtctgtctgaactctcttgttgattgttttattcattttgcctagcaccagctatactaggtaaaattatttttaataggtaaaatatataattacctatatataattttaataggtaaaatataaaataataggtaaaaatatttttaaattcactatttttatttacacaattttaaatctgcttttcatagttgtgtgaataggtttgtattgttatttcatatatcaagttccaacttgctttgggtcattctgatgttggaattcatgcattttttactttaaaggtttacagtgaaacataaaatttcctattacgaagtacagggctgcaatgtagaacacaaaaataaaacctgaaaaacaaggttaattcttactgggaaaagtgaaggagtggttaaatatcttgatttagaaataagcatgtatacaaagtgttcagcaccactttttttaatctaataaataaaaaggatataattaacaaaccacttcaacaataaaagttaaagcaatagctagtttaaaagagcgcagtcatcaagcaatccccaatacttgcaaaatttcttaaactcttgcatattgataaaattccaaataaccaagatgtagtttatattaccaagtgtcttccatcatatgctttatggtgtagaactaaaactagcagatatagatataaacttgaatttgttatgcattagcttggtgaccttaaattaactaactttcctgaacttcagttctaaaatgagaggcattacttagaagagttttgaggctcttttccatttgaaaatcttggcacttcattatgctgcatgttaattggtagcaactatctctgtttactccgtttttatactgtatttatccaagcatcaatccaatatttattgagtgtctactctgtgctaggcactcgggttactaaaattcccttgtggggtctgagtatagtgggacaagcagacttgtgtatatatatattgtagcacagaggtgggtcccctgcaggcgtaagaacaaaatacctgtagaagggacagccagcagagtccaggtgaacctgaacattgaaggattagtaggagttagacagtggagaaaagaggaaagggcattctagaccaggagaagtgcacttgcaaatgtgaaatatcttgaaggggctttatggtttggaaaaggagaatttccatgtggctggagcacacaagagaataaccatgggagcaggaggctggaatggaaggtttgagtgaatttgggaagggactttcttagtaacgagccatgatcaggaagctaagaaagttacagtctaaggaatggagattttaacttaaatgtgccatattaaaaataaaggtaattaggttttcaccatgtactccacttgagcaaatcctttaacctctctggactttaggttctctgtaaaatgtgatcattagactttcccaggccttccctctagcaccatgcttctgtttttcagtcttcttatgtttatctctaaaactgcagtttctggttataaattgctgtgcaggctactccatttgcaaatagcttggtttctccttgtttcaacctcaaataacataaaagtctattaccaatacataatttgtgagtctgaaagaatgcattctggtaacattttataactttttaaaaagtggcatgccttcatatggtataatgtaaatttaaatattttgatttagccagactaccaaatagtgttctatctttaatttctggtgacattagtatgctgactttttaatgtttactatttgtcaaaatatgtagccaatttttcaccagcaggagaaatctcctacatcaccttttaggtgtgctagaaaatgcagctgctaaaaatcaattttccatttctgaaaagtgcagatccttgtgtatctgcggcttatatttcaaacagcatttgctgcttacagcttaatcttttaaatggtcactgcaactttgcctcattatccatatatatgtccattatatgcagactcatcatttgtgtccaaacctctgtatctttgctatagtctctgaggaggtatagttacatattcaacagagactgagaaagataatgtaaaaattctttttcacatttctttgggttagaaaatcattttgcagctgatagggtgtgtgtgtgtatgtatatatatatatatatatatatagcttaatagtttatttttagaagtctcaacattagttattatatcaatcaatgtctactagaaagcaaaatggaacctgagctgaggcatccaacgggagtacagttaatgtctcttagatatggaatcgttttctgactacacaggatgtacttgtctgtacttgccttttcccattgcaaataaccttccatttcaaatccacactaaaattgatcataaaggtagctttgtaagttctttctcataacataacgtgaaaagtaacttgacagcattaaggcagccaaaatcaacacatctgtgtgctgacatttcaagtgatttatgtgcttatcagactgctcaatacaataatgcataattacaaaatctactgacacataaaagaaaactaatcatacttttgtgattcaggcaacttctttttgaaagacaaatgcaagtcagttttatatttattaaatgtaaatacattttcatttgaaattttaaaaataattaaaattttgcttccataagtgctagaggaaaacagtcctcctttcatgcttttctctatatttggtgtttgtcccattttgcacaaagctcatctgttctagccaggaatggagtggaagagctctctctgtagagctggcacaggtagattcaatggtttcttagtcatttattgcctgggtattcctggaaaatcctgtgccctctctgagctgtttcttctactgtaaagtagccttcataacaactgcccctgacctccttatacaactgcttgcagtgtcaaatgagagcggtatgaaaatacttctgtacaggtgaaatgctacactaaaatatattttaaattaattttcctttatatctagtcaaaacatgtttgttcctaaagagcaacataagccaagtctcctggaaataaaatgataccattacaaatctcaatacaaaaatgcaataaagagtaataagccgttatataatggccaataaggataacatttctcagtcccagaccaagaacaagtaccactacttgtagaattgctcaacctttcagttctttaacactctgaaaagtagtatttttacaccattgaaagatgatttttaaggaaaaacaaaatcaaatattaagttttttgttggcaaagttataaagtaaatttctgattgtttactttagctttcatgtagttcaggataattgaataaatccctagaagtggaatcatggttcctcagaaatgtaaactctgggaactaagcctatggcaaaatataattcctgcttcattttaataaatgctgaacaaagagaaatagccactcctccctatctgctcttccatgtaaaagaaaagattcatcccattagataaaggtctggaatctccctgatgtcttattgtcccctgcccccacccccatgagctaaggctacttctcttcccaatgtccaaatgtgaggctttgctatcagtgctacacaacagagaaggctcccagatagcagagatagtttgtccaggagaatgttgtgattttcgctttgctggttctgtctcaaaatatgcattgctccttatctcctgggaagtgaatatggagtatccctgatggttcctttgggtctttgtagaatgcatcatttgaatgaaaggggacaaagactgaggagaatacaggatggctaaagggataagtaaatattgtaagagatatttgactaaagtatggactttaggtgtggtggacagagattgaggtggctcccatgatctccacttgcctggtattctcgtacttgtatattcgcctttcctgaatgcaggtgagacctgtgatttgcttctaaccaacagggaatagcaaagattagagatgtcattcccttgatcatgttattaagcctccatctgagcagactggagctagagtttctcctagctggcttgatacagtcagtgaccatgttgagaagctacatggcaaagaactgtgagtgacctctaggtcttgaggggtagcatccagctggcaactagcaaaagggctgggctgctctcacacagaaacaaataaataaattttgccaacacttgaatgtgcttggaagcagatttttccctgtgcaatcttccagatgagaatacagcccagtcaacaacttaattgcaaccttctgaggccctgagcagagaacccaataaagccaggtctggactcctgagtcacagaaactgtgatacataggtattcttttaatttgtaataatttgttatgcagcattagaaaactaacaaaccggccaggcacagtggctcatgaccataatcccagcactttgggaggccaaggcaggcagatcacaaagtcaaaagattgagaccattttggccaacctggtgaaatcccgtctctactgaaaatataaaaattagctgggcgtggtggcatgcgcctgtaatcccagctacttgggaggctgaggcagaagaatcacttgaacctgggaggtggaggttgcagtgagccgagattgggccactgcactccagtctgccgaccgagtgagactccatcacaaaaaaaaaaaaaaagaaagaaaagaaacctaacaaaccagattacaagtggaagtcagaaagaagacttggtgaaatgattatcagtaacagagaggtaaagaaaatgggttggccgggcacggtggctcacgcctgtaatcccagcattttgggaggctgaggtgggtggattaattgaggtcaggagttcgagaccagcctgcccaacatggtgaaacccatctctactgaaaatacgaaaattagctgggcatggtagcgggcacctgtaatctcagctactcaggaggctgaaacaggagaattgcttgaacccgagaggtggaggttgcagtgagatgagattgcaccactgcactccagcctgggcaacagagaaagactctgtctcaataaataaataaataaataaataaataaataaataaataaataaataaaataaaagagttaagtgcagagcacagggcaacatgaggaatggatagtgtaagagtttttgcattatttacaaaatgtaaaggactgtatttgtcaatgaaaggtgaagcacactgctgtacagcaatatctttagggtacaaagtaatttcaagttatgctgtactttttagatcctgaaacttttcttcctattaaacatgtatattctttgcttcttaactgtttatccctgtactgcatgtttcattttcacagctttgtttagaatccctacatcaactggcccgttcccacatcttttccttacctggttgaactgcaagaaactctttttttccaacaacataaatagtaagatctgacattgtaaaagtcctcttttataaagaggaagcatataatgaaatagttaaatcttttttaattagaataagctagatgtactttctggtaaccaatcactctatcttactgattctgcctcatcgattcaccatctacttccaaacttcatccaacaacatgttttctttctatgatcacacctcttactttctcacttttattcaattccacatgaactttttgaaagttaacacattcatttcctcaacactgtacccacaatcttactcgctaggccattcattgcaaattagtcttggccataatttaagcagcatagagaacatagtaagtatcgtggcgacttggtactgatggcattggggagccaggggaaacattgtggttgtatgtaatcactcaccattagaaagagcatcttttaggttttggcaggatgttgacatatccatggactacatgccacccttatcacaggccgaccgcggaatttccttcctaccgtttttcctcctgctaccttggtgagaggcacctatctccctaaagctcccctggcagaatgtgaatatactcagatcctctgtcttgatgaacctatttgccgtctacgtttggtagatttgtggattcagataatttcaatgttatgccctggaatcaatcagttggccactggaggtttcaaacctcagtatgtgctgcacatactgatgtggttagatattcttcttaaattctaaaccagtggtattcaagaatgccttagttatggcccatttttgtaaacatacatcatcttccagtgattcaatcatgcaagaacaatagtggatattaagagctattgtcactgtgctacatttccaggtggaattcccacaatggactataaaaccacttaaaggtagacagtgtaactctattgtagttcataatggtgaagaattgaaagagtataacaattgtgttcaaaagtctatttcatgaactctttagattaaaaatctatgttcaatccacagacaacaataaagaaaatactgatccagcaattatcaggttgatttagacaatatacttcatggatctttgtaactaaaactaaatactcccttaattttcaaaagcagctatataatacatggcctactacaattacgtcaatgaatggttcaaaatattgctgtatagatactaattaacaaagcagcgaggaagagaagaaggcaagcaaataaacagttggaaacaaaatctttacaagcaccaatggtttaaattatgcttattatcatattattaaaattgtgttcatagtcaattccagctttaagttaccgtatcagtgaaaacactgagatatttacaatgagatatctgcatatatttcaatatttcactatttcaaactaatcacagcacgaagtaatgaaagacattttatgtaaatctattaattttaatgttatagaaatatcattgtaaactagtatattattataatgtattatagtctgagagttatggccatagagttatttttatatactctatttaaaaatattaaaaatatttttaaatctttttattaattaaagactttagttttatcttctggataagtaatatgaagctacaatgttttaaatttttggttcagatttagtgcctatccaagatactgctgaagtacctgcggaagtacaagttgctattgaggaagattcaacttacctaaataagagaaaatcttaaaatagtcaatacgaaacattagaataaataattccagcaaggaaggaataaaagagcctaattagtaataaactgcactttaaacaaaaccttaattattgtaaggcaatatttctttattttatttatttattgagacagggtcttgctctgtcatccaggatagtgtacagttgcccaaacacagctcactgcaccctcgacctcctcggctcagttgatcatcctacctcagcctcctgagtagctgggattacagacaaaagccactgtgcctggccaaggcaatatttcttgactttataaaaggcatgctccctttgttgaatatagagattgtacacccttcatattatttagaaatgtaaataaatctcatgacttaaaaaatcaaagtatttgacaaagtgatattttatttataaaccacacatattttcttccattctccattaaaataagaagcccttggggtgcaccatattccctatctgcatccttacctttgctctataaatgacagcctttaatcacatcaaggaaagattgaatagaattttagagaatagctactgaatctcttggtctccctaccacaagatacccttcttaaattctaaaccggtggtatttgagaatgctttagttatggcctgtttttgtaaacacagatcatcttccaaggaatttaaatgtgtaaaatagtgagagctgaccactcagactgactgataagggagtgagtgtgttccaaattcatttgttgagtcttcctctctgccctccctagcacccactctgtatacccaggtcttccaaggcaatcctaagcctctgagaaatataactgggaaacaaccaatttaaaatatgttaccaattctactgttgcttatattacacccaccttcttatcctgcttcattttttggccactgtggtccctaatgctttccacaactatgtgcagtgctcttaaggggaatgtcttagtagtatgctccaacatggttatgttaaacggtcattgaaaaccttgcaattgtttatatttctccattgtttttgtgtacataggcattttacgcttcctttatgatgcaaacagttctaagatcctcccataaagctagggttatgaaacttaatttataaggtactttcagataactatactctgtttcaataattactatatgttattcctctatcctcagtagactaagttaaatagaagagattttgattactttatcaagttactttttggaagaggatttaaaaccaaacttacagaaatccaatgggaacaatttcacaaggcttttttttttttcatttcaattattctaccaatttaggctactatgtaaaggtttttatttagcaaaaaaaaaaattgctttttcaaaaatctattttttctctaaactcaggcaacaaaaataagttgcattaaaatcactcatttaataagctgtttttcctataatggctgaacaagagaaagatctgaataaaagatgtaagatgtatagtttggtaattgttacagattctctttttggctggcattttatcagagagaaacactgtttaccaacaccacattgcttagttctttccaaattacttcttgcctggagagaaaacatggatatactaggtgtatttccacctaaattatgtgcacagaaaaacattcttcagtttgttttttaaggaaacttgtttcccattggaattgcttgatcaaaattaagataaattagaaaatatcattatgtgccagggtttttattctgcaaattctaacttcttagcttatctcctttttatttctttcttcctcatatatatttcaatagacaaacagtatgtgaaaaatgctcttttccattgtaagagcaattatgattaaatacatatgtgtgtagtgtgtataaattttgtgtattttcccttcctttatagcagcagttttacttatctgttttttgtaaaagacttaatgacaaattaaggttttaagaattcagtgacacttgaaaaaacatttttatttaattcccgaaagcagtatacacacgcacacacacatacacacacacacacacacacacacattttattctagagacaacacttcattatgttagaaatctatgataccctacagaccatccagccctcttctcagctcccctaacaccagggggtttgcaggaccctagcggagattcatcacatttgtacataaacacacattttggaggagaaggctgaagaactaagcgaaggcatttattccacgagggtcacttctgtaatgtccccacatggtactgggcattcaactgatgaactattgaagaagtgatctctgtatcagtctatagagtagaattatccagcaataatcattaaaactgctgagtcgttgcatactaaaaatgaatattgaatctaggaagctgaaactttaatccattttcatatactcttaaaatttttaataaaattcaaactcggtcagacatatcacataattactttagggattaaaaatatcataatctctcctgacaagtcattttaatggtcagtgaatttgtatgctatctgtgatcttacttagtggatatatctcaatttctgctttattacattccattaccatgttttattcatctgcctattcctctcctgcttaaaatttccaactgagaaaagaaatgctttaactttcatgaaggctgaatcctcctcctatccagtaagcaaggctctgaatctgattacattcttgacagacatattttttatctataatgagctaagacaatgtgcactctaaatttaccttggcttctgtaattgatcaattaggaagcataaagtatagccactatcttcatattttttcctgacctgtttatgagtaatcttaagcttctttcatttcagtagtcaaatttaatgatccctggtaaatcggaagacattttgagatgaataatctaggtgaaaaggagagcacggtgtttctgattaactgtggttgttcctataagcatggcagtcaatacattatgtaagtgccattgaacaaatgcaaacctttataataatattggacacaaagcaattaaatagtaaagactcattacagtgttgagtagaattttcatggtgcctatatttctggataattatagttatgttttccactttggtattcaaacagaaagaatctgttcttactaaaaggatgttaaagtacccctctctttatcccaatatgtggaagaatactgagcagcagaaggaacaaggctgccaatgcagcaggagacattgatggtgccaaaaaatgcactcaccctgtattctcaaattaagagccaccattgccaggtgaagatttatttgttctttgagcaagaagcagacatagcaacagtgacagtatggaggaatgttggtatagcacatactggagaggaaccagcatgagttactgggcttttgctaggttctgggtaccattttgtgtgatgatatcatcagtccattagtcagaggtaacatcccaataaacaggaagtaacaatgcaaggtaatgagtgctatgatgtgggggaatattccacaggatgcaataaaagcagctattcaaccttgggaggtcagacacgtcttcctagaaaaggtgatatgtgacataaattctagaaccatcctactgtactgaccaaaagcattagcattgtctaggagcaactgatataaatacagaatattatgcccagcctaggcctactggaataaatgtgtattttaaccagatctctaggtaattcatacatacatttaagtttgagaagcactgttctggaagataactggtacatagccaagtgaacaggcaggaagacagccttctaggcagagggaacaatactggctaggggatagagggagaaaaaaacttgtcctgtactgagaaatgcaggcatatactggttggtatggcagaagaacagggtttaatgggaaaggtggctggaaatgaggtaggggaaatgtgcagtagttggataatattaagttgataatcagataatgctatattaagcagttggactttctacaaggtaatgattaatagaaccaattttgtattttagtaagattaactgctaaatggagatctgatagcaggaagaacatgcagtagttaaagaaatgaaaatgatgaactaaactagatagtggcaatgaggatggaaagaaatgcacaaattgaagaaatagtaacattaaaaatttgagaagacttggtgagcaattgagtaaagagggttaagagggtttggcagtgaaaagagaaattcaggatacctccagatttctggtttaggcatgaaagtagttggtgtgaccaatccctgagaataaagatggaatttagatagaaaaggtaagccatgtggaacacgttgagtttgaaatatctgtagaatgtccaaatggtaatatctagtaaccgtttactacataagtctagagctataaatacgaaagtcgtccacactgagttgttaacaaagacttaagagtggattatagtcagaggtggagaaagatggccaaatagaagcctgtattgatcatcctcccgcaggaacaccaaattgaacaactatccatacaagaaagcaccttcataagaaccaaaaatcaggtgagtgatcagagtaactgggggagggagaatgaagtgattgtgggactgtgcattggaactcagtactgccctgtcacagtggaatgcaacaccaggcagaactcagcctgcgcccatggaggaagcatttagaccagccctagccagagggaaatcgcccatccagcagtaggaacctgagttcctgttagacccaacactgcaagctaaagtactctgggatcctaaaaaaacttgaaaagcagtctaggccacaaggactttaatttatggaaaagtctagatgctgtgctaggctgggagcccgtggatatggggcacacacggcccagtgagacactagctagggcagccaagggactgcttgtgtcacccctcctccaactccaggcagtgcagctcaaagctccaggaaagtaaagaggacttggtcttgcaacttggacatagtaaaataaatcatggagcagagtcctgatgctctcatttcaggccctagcacccagatatctcaagactcaacctggaacagaagggaactcgctacgttgaagggaaagaagcagttctggcaggatttatcacctgctgactaaagaacccttaggtctagaataaatatcagcaggagacaggcagtagttgccatgggcattgggtgatacctagtaccatgatggcttttggtgtgatccagcacattcccagttgtggtggctatagggagagactcctgcttgagggaaggagagagaagagtgaaaagcactttgtcttgcaatgtggatacctgctcaggcactgtaaaataaagcatcagagactcccaatttctctaattccaggccctagttcccaaatggcatttctaaaccagccctggggcaagaaggcaacctgctgccatgaagggaaagacacacatttggcaggattcaccatctgctgactaaagagcccttggtccttgaataaacctcagtggtaccaggcaatagttgctacaggccttcggcaagacctggcactgagtactgtgccagcttcaggtgtgacccagcactgtcccagtggtggttatgggagtgcttgcataatcttttccccagttctgggcagctcagcacagacagtgactccatttgtttgggagacagtaagggaagagaataagagattgctggtaatccatagaattctcctggatctcatccaggaccatcaaggtggtacctctacaagtctgcaagagtcacagggttactaggcttgagatgccccctaatgcacatgtggctgcaatgaccaaagatgtagatcacaacacttaatgttctttgaataattggaaaaccttcctaagaaggatagatacaaacaagcccagattgcaaagtttagaataactacgtaagtcttcaatgcccagaaatcgatgaacatccaccatcattaaggctatctagacaaacatgacctcatcaactgaaataaataaggcaccagtgaccaaacctggagtgacagagataatcaaactttcagacagaaaattcaaaatagctattttggggaagctcaatgaaattcaagataacatgaagaaggaattcagaatcttatcacataaagttaataaacagaatgaaataattcttaaatatcaagcggaaattctgaagctacaaaattcaatggaatgcatcagagttttttagcagcagaattgatcaagcagaagaaaaaattagtgaacttgaagacaggctttatgaagatacacagtcaggggagacaaaagaaaatagaataaaaataatgaaatatacttaaaagatctagaaaatagcctcaaagtggccaatctaagggttgatggccttaaagagaaagtaaaggagataggagtagaaagtttattcaaagggataatagcagagaactttccaaacctagagaatgatatcaataaccaagtatatgaaggttatagaacaccaaacagattgaaaccaaagaaaactatctcaagacatttaataatcaaaattccaaaggtcaatgataaagaaaggatcctgaaagcagcaagtgaaaagaaacaacacacagtggagctccaaaacatctggcagcagacttttcagtggaaactttacaggccagaagagagtagcatgacatatttcaagtgctaaaggaaaaaaaaaaaaacttttattctagaatattatattcagcaagaatatccttcaaacatgaaggagaaataaagactttcccaggcaaacaaaaagtgagggattttatcaataccagacctctcctgcaataaatgttaaaagtagttcttcaaccagaaaaaaatgatattaatgagcaacaagaaatcatctgaaggtacaaaactcactggtaatagtaagtacacaggcaactacagaatattataacactgtaattgtagtgtataaactacttatatcttgagtaggaaaactaaaaaataaacctctcaaaaataatacctatgaccacttttaaagatttagacagcataataaaatatgaatcgaaacaacaaaaagtgaaaaagcgggggataaagttaaaatgtagagtttttattagttttctctttacttgtttgttagattgttcgcttttgcaatcaaagttaaattgtcatctgttgaaaaataataggttgtaagatgttacttgcaagctgcttggtaatctcaaatcaaaacacctacaaaaaaaaagagcaagaaataaaaacataccaccaacaaaaagaaaatcactcacaaaatgtaaaagaggaagaaagaaaggaaaaaagataaatccacaaaataaccagaaaaatccaaggtgacagtattccagaatagaccatatgttaatccacaaaacaagtcttaaaaaactgaacaaattgaaatcatttcagacatcttcactaagcacaatggaataaaactagaaattaataataagatgtactttggaaattatactaacacatggaaattaaacaatatgctcctcaatgaccagtaataaataaataaataaattttatttatttaaaaataaaatttaaaaattttttgaaacaaaagaaaatggaaacacaacataccaaaacacaggggatacagcagaagtggtactaagaggaaagtttatagcaataagcacttacatcaaaaaagcagaaaaaccacatttttatttttatttatttatttttgagacagaatctctgttgcccaggctggagtgcagtggcaccatctcagctcactgcaacctctgcctcccaggttcaagcaattctcctgcctcagcctcctaagtagctgggattacaggtgcctgccaccacacctggctaatttttttgtatttttagtaaagatgaggtttcaccatgtaggcccagctggtctcaaacttcagacctcaggtgatctgcctgccttggactcacaaaacgctgggactcacaaaatgctgggtggctgtgagccaccgcacctggccaaaacttcaaataaacaacctaaaaatgctttctaaaaaactagaaaaccaagagcaaaccaaacataaaattagtagaagaagataaagatcacagtagaaataaaccaaacttaaaaaaaaatcaatgaaacaaaaagctggtgtttcaaaagataaaatctacaaacttttagccttactcccccactgccaaaaaaaaagagacaagacccaaataaataaagtcagaaatggaaaagaagacattacaactgccactgcagaaattcaaaggattactagagaccattaatatcaactatatgccagcaaattggaaaacctagaaaggaatgaattaaacatagtaatgcttaaaattgaaccatgaagaaatccaaaacctgaatagattgaagccataataaaaaaatctcccatcaaaggggacttaatggcttcactgctggattctaccaaacatttaaagaagagctaatactaatcctactcaaatcattctgaaaaatagaggaggaaggaatacttctaaactcattctatgaggcctgtattacccagacaccaaaaccaaagacacatcaaaaaaataaataaatataaagaaagaaaaagaaagaaagaaaactataagccaatatctctggtgaactgatacaaaaatcttcaaaaaatattagcaaaatgaattaaaacaccttaaaaagatcattcataatgaccaagtgggatttttcccaagaatgcaaggatggtttaacatacacaaatcaaacaatgtgatgcatcatatcaacagattgaaggacaaaaaccatatgattagttcaattaatgctaaaaaggtattttataaaatttaacatcccttcatgataaaacccctcaaataactggggatagaaggaacatacctcaacatataataataaaagccatacgtgacacactcacaactagtatcacactaaatgggaaaaaaaactgaaagtattttctctaagatctgggagaagataaggatgcccacttttatcactgttattcaacacagtactagcagtcctagctagagaagctagccaaaacaaagaaatacacagcatccaaatgggaaggaagaagtcaaattatccttgtttgcaaatgatatgttatttttggaaaaccctaaagactccaccaaaaagctattagaacttataaacaaattcagtaaagttgcaggatgcaaaatcaacaaacaaaaatcagttgcatttctatatgccaacagtgaaatacctgaaaaagaaatcaagaaagtaatcacatttatgatagctacaaagaaaataaaatcctggatggaattcccagagataaccaacaggctctctgacattgcaactgcagaggtacttgccattgctgcctttggtcagtgaaccagagaaagaccctgattggttatttgcacctctagtaggccaaaggtactctctatggagagaaggccagtttctcttccctgtgaacccttcaacccctgctcttctctaggcagggcccctggtttgggcccacagcacagtcactctaccagtggctgaacatttccactgacagaggctttgtgtctctctggggtggagttcctggaggcaactgacagcccctctgccactgctgttgtagtgctacccatcttggctgccaccaggcttgggaagaaacaaaaagcccaaatgttttatttgcacctccaggacaccgcagccacactatagaaaggaggccagactgttttcactgtgaatcccccaggtccccgctcttcaacaggcagggtcctagcttaggcctgtagtgtagccactccacacctggctgatgattttgattggcagtggttctgtatttccatggggtgtaacttcaagagggaagtggcaggcctctgccattgccactgccaagggccctgtccctgctgccacaaagtgaggagggaacaaaaagcctgagctatccccaaggtggcagcatatagcccagggtgccaagctaaggtctatggccaaaactcaagtgagagggaagctcacactctcagagcactgagagagtgcatggctgcaaatgcgaggaaatatagagaagctgcaaatccttaaagaaaacaaattctaagcaagaattccatatctagccaaactaagcttcacatgtgatggagaaataaaatccttttcagattttactcccctttgcaaatgctaaggaaaatcattaccaccagacctctattacaagaagtacttaagggagtgctaaatatgataacaaaaaactgctattggccactacaaaatatacttaggtacatagaccattgacactataaagcaactacatgatcgagtctacctaacaatcagctaacaacatgatgacaagattgaacctgcatatatcagtattacccataaatttaaacaggttaaatgtcccatgtcaaaggcacagaatggcaagttggataaaggcgaggacccaaatgtacgctgtcttcaagagatccatctcacatgcaatgagagataccataaactcaaggtaaaagaatggagaaagatctatcaagcaaaaagaaaaaaaaaaaagaagaggggttgctattcttatttcagacaaaacagacattaaaccaacaacaatcaaaaaggacaaagaagtacactatataatgataaatggttcaattcaacaagaagacataactatcctaaatatacaggcacataacactggagtatcttaattagtaaaacaagttcttagagacttacgaagagacttaaataaccacaaaataatagtgtgagaatttcaacaacccactgatgatattagattattgacatagaatactatcaaagatacttggggcctaaacttgaaacttgaccaaatggacctaacagacaactgtagaacatgccacccaaagagaatagaacatacattcttctcatctccacatggcacatagtctaaaataaccacacactcggccataaagcaattcttaataaattaaaaaaaaatccaaaattataccaaacatactctcagatcaaagtgtaataaaatcaatatgaagtacaataaatcaatatgaagaatatctcttaaaaccataaaattacatggaaattaaacaattggctgctgaatgacatttgggtaaacaataaaataaagacagaaatcaagtaattatttgaaactaatgaaaacaataaaaatcataccagaatctctgggacacagctaaggtagtgttaagatgaaagtttagagcagtaatgcccacatcaaaaagtgagaatgttctcaaattaacaacctaacatcacatctagaggaactagaacaacaagagcaaaccaaccccaaagctagcagaagaaaagagataaccaaaatcagtgctcaactgaattaagtagagatgagagaaaccatacaaaagactaataaattcaaaagtttgttgcttaaaataataaataagattgataaagtgctagctagactaataaggaaaaaaaatgagataagatccaaataaacacaatcagaaatgacaacgatgccattacaattgattccgcagaaatactaagaaccctcatatactattatgaacacttctatacacacaaactagaaaacctagaaggaatggataaatacattcaatctcccaagattaaacctggaagaaattgaaaccctgaacagatcaataatgagttttgaaattgaatcagtaataaaatacctacaaaacaaaaagcccaagatcagatggattaacagctgatttcttccagacttataaagaaaagccactgccaatcccactgatattattccaaaaaatcaagaaggagggactcctatctaattctatgaggacagtatcattctgatatcaaaacctggcagagacacaacaaaaaaagaaaacttcaggtcaatatccctgacgaacatagatgtgaaaatcctcaacaaaatactagcaaattgactctagcagcacatttaaaagcgaatccttcacaatcaagtaggtcttattcctgggatacaaggttggttcaacatacacatatcaataaatgtgtttcatcacatacacagaactaaaagtgaaaaccacatgatcacctcaatagatgcagaaaagggtttgataaaattcagcatcccttcttgttaaaacccacaacaaattaggcatcaaagcgacatacctcaaataataagaacgataaatgacaaacccatatccaatatcatactgaatgggcaaaagctggaagcattacccttgagaactggaatgagacaaggatgcccactctcacctattgaattcaacatattattggaagtcctagccagagcaatcaggcaagagaaagaaaaaaagcatccaaataagaagacaggaagttaaactatctctcctcgcagatgatatgattttatatctagaatactcccagagtctctgcttactagctcctagatgtgataaacaactttagcaatgtttcaggacacaaaatcaatgtacaaatatcagtagcatttctacacaccagtaatgtccaagctgaaagtcagatcaagaatataattccactcacaatagcattaataataataataataataataataataatagtaaaatatctaggaataagggaggtgaaagatcactacactgaaaattacaaaacactattgaaggaagtcagacattgtcacaaaccaatgaaaaaacattccatgctcaagaataggaagaataaatattgttaaaatgaccgtactctacaaagtaactgaaagattcaatgctattcctatgaaacttccatgacattcttcacagaattagaacactatgcagccataaaacaaaacaaaacaaaacaaaacaaaacaaaacaaaacaaaacataacagaatcatgtcccttgcagcaatatggttggggctggaggccattatgctatgcaaactaacacaggaacatactgtgtaacaaaccaaatactgtatgttcccacttgtaagtgcaagctaaacattgagtacacatggacacaaaaaaggcaacaatagataccagggcctacttgagagcagaggttggaaggaaggcaaggatttaaaaaagtacttaacaggtactatgctcattacctggatgatgaaataatctgtacaccaacccctgtgacacacaatttatctatggaacaaacctaaacaggtaacacctgaacctaaaataaaagttaaaaggaaaatgtttccagttaattacttgaatccacaaagtgaagcacacatgggaaataaaacgtttaacattataaaattttaaatatataattgttctcctgtcttttttaagcttatttaaagcaaagaaacttatataaaaaaagaattatactacagaaccacagtaaccacaacatcatggtactggcaaaaaacagacatatagaccaatagaatagaatagagaactaagaaataaatccatacatctacagtaaactcatttttgacaaggcaccaagaacctacattggagaaaagagtgtttttaataaatgatgcttggaaaactggatatccatatgcagaagaataagactagaccaccatctcttgccatctacaaaaataaaatccaaagatacaagatttaaatctaagatctgaaactatgaaactactaaaagcaaatattgggaaagcattgatctgggcaaagatttcttgagtgataccccacaagtacatgtaaccaaagcaaaagtggacaaattggatcccattgagttaaaaagcttctgtacagcaaaggaagcaatcaacgaagtgaagagacaacccacagaatggggaaaaaaatagcaaactatccatctgacaagggattaataaccagaatacataaggagttcaaacaactcagtaggaaaaaaacctaataatctgatcagaaaatgggcagaaatctgaatgacatttctcaaaagaagacatacaaatggcaaacaggtatataaaaaggttctcaatatcattaattgatcattacagaaatgcaaataaaaactacagttagatatcatgtcattccagttaaaatggcttttatctaaaagaccagcagtagcaaatgctggcaaggttgtggagaaaagggaaccctcatacactattggtgggaatgtaaattagtacagccactttggagaacagtatggagattcttcaaaaaactaaaatagaactaccatatgatccagcaatcctactgcttttgtatacataccaaaaataaagaatctcagtatatcaaaaagatattcctactcccaggtttattgcagtattattcacaagagccaagatttggaatcaacctaagtgtccatcagcagataaatggataaagaaaatgtggtatatatccacaatggagtaccattcagccataaaaaatggataccctgtcatttgcattagcatggataaaactggaggacatcacgtcaaatgaaagaagctaggcacagaaagacaaacttcacatattttcactcatttgtgggagctaaaaactaaaacaattggactcctggagacagagaatagaatgagggttaccagaggctggaaagggtagtaggggttgcaggagtaaagtgaggatggttaatgggtacaaacatatggttagaaagaagaaataagatctagtatttgatagcacaacagggtgactacagtcaacaataatttattgtacatttaaaaataactaaaagattatcattggaatgttcataataccaagaaaggataaatgcttgaggtgaaggataccccatttactcttaggtgattattaaacattgtatgcctgtatcaaaatacctcacatatatctcatatacacacctactatgtacccacaaaaatgaaaaaaatattagatgggaaacagagtggattacatcacccagggagagcattcaatttgaatggaaaaataagatggaatattgggtaacaccctcctttgatgggcagaggaaaaacagcactaaaaacataccagaaaggattagccagagggttaggagaaaaatgatatattattaaagaagaagtaatgttttaataatgtaaaatctttattgctgatgtgaccttgctaaaagcagtttcacagaaatgatgggataaaaaagtgagtaggaggtgggaggaaggttaaaaataagtgaggataataatcagttgactgctaatgaacgagagagggaatatcttaaggatttttgttttgttttgttttgttttgtttgtggggggaaacagggtctcgctctgtcacccaggctagaatgcagtgatgggatctcagctcactgcaacctccgcctcccaggctcaagcaattctcctgcctcagcctcccgagtagctgggattacaggtatgcaccaccacatctggctaattttgtatttttagtaaagatgggagtctcactatgttgcccagctggtcttaaactcctggtttccagtgatctgcctgcctcagcctcccaaagtgctgggattacaggcgtgagccaccgcacatggccacttcaggaatttttaaatacagaaatctaaacttggtgggcctgcccaagttgttttgtttcattttaaagtattttcccaaaataaaaaaaaataaaaacagccactttctttataaaatcctgcttaatgaggtttatttctgtttaagtttgtagcatgttatgcaaacatcaaaactgcgaaattgtggaagtgatcatcattaacctgatgaccattttgctatagggccaagaacagatggagccggtgggatctcctgacattctttccaaacttggaaaatccagcctgcaatatgacaaaatggtattttcactccctgggacttagtaagcctttgttttgaataacaaatatgtttaacatattaaagtcaccatctatctatgatataattaactatagaaaaaaaacctacacgtgctaacattattgtcaggcaattaaacaaaattccaggtagattaatgtttaatttaatgagctaacatttgaattaagatcttgtgacattaatgatatcgagagctgtcaagagtgaagagccctgtcatgagtcgctgctacacaaacatcacactgagcctttataatggagaaatggatgactcgagaccagaaggtctctaagcatgactggaaaccatggtcaaaacctgacatttgaaatattgctggttgtgggaagaaagaactttccacagaccaggcagatggtcatcatatactacgcacaattcttctttccctccaccctacatccctgtccctgtcccagatgggagaccactaccaccaattaaggcaagttgcctgcaaaagttctttatgtttcattggtaatgactcgatagagcaggtgtaacttcctcacttcataaaggctgaaactgagcaaagtgaagtcaggcaacttatgcaagtcacacagctagcggactcaaagcacagtgtggcagatgccaacattcgtgcctacaacagtaaagtaccacctcctaggaactcattagtacttacatttcaggcttgtgtttggggttgtgtttggagtttaatgtttcacattgacatctctcgtttcttcatctttcttattcctagagcttatctttctgagcattgtttatatcaagtaaccttttcttacaattacctcacataaaatttttactctataatttgagaactttataaccatgatccattttactcattttatctcattctttttaaaaaatctgattctttataacattttgcttgtgtacttccctatcatactgtgcaaggctgctaattttctccagttttgttctatttatttcactctgttctattctcttccaaaattattatttttccaaattatctttccagtacaggttctatttcctccaattttttaatatttagttgtagtttttataaatgtaaggtacagtttctattatgtttctgtccagttttacaggtgttatttaatgtgcataatactgtatactgttttgtgcttcccattttacaaagcctaggtattatctcaactaattatcctttttcatatacacaatcaccctaattgaattacaaattctatcatgttctttgtgaattaaataaatctgggatctgctagcactggctgttttgtaaatgaatgtcaaccaggcagttcacacgtatgttcaatcacattctcccctacaggagagaatttcagataggcatgaagcctaggacagctgaagagtgcttctggaaaacagacctagacttcacccagtacaaagtaaattcaccccaatgatcaggtagtatatatcaagagcatcctgaacaaagtcagggattgtatgtaaaatgggatgaaacaagtccttataaaaatggctccatgtcacatctcagcgtgtaaggtaccatctatgctccagtgagaacttttaaagctaaacctctgactatagcatactgtgttatctattgctttatataacattgccttctgtttccatatccttctctgttaatgacatttcacattatctgtgtctttacacatttttagtagctacatcactgtccactgcaaacccacaggatcctagacctgctctttctctaatcttctgtatcttagcaatcggccaaaaaacttgaaatcatacttgatttctcctggccctcaaagcctacattcattctgccaaatcatgtaagtccatctttaaaatttatactgactgtgcatttcttcttatctccattactatcacccaagttcaaaatcctttcttatttttcacctgagtattgcaatattttcttagatgaccctaactgatcttgccgtttctactcttgctttcctacagtcaattctcttcatatatgccaacattaccttttaaaactacaaacaagttcaggttacttcttccttgctcaaagtctcaaatatctttttatcacacacaaatcaaaggtggctaagaatggtctgggtcctgcatacctctccaatgtcatctacagcatctctgactttctcgcactgctctggtcacagtggtcttctttttctctaatacactaagcttattccttctttagggtcttgacttttgcctttctccccaaaacttatattgtgtggcttgctttctcactttattcaatattcaacaagtctttagagaggtggcccctctgactactctatctaaaacagcaatcccatttacatactctctctctatcgattttgccttattttgcatttactttatggcacttttcactacttgatattatcattaatttcactggtttgttgactggcaccttctccactagattataaattccacaaaggcaggaatttggtctgtttctgtcttctctaattccagtgactagaatgattcttgttacatggaatgtgctcaataaatgtttgttgaataaactattactatttacatccacctttacaggaacattttgaaggaggacagcataacagggaggtgtcctaatagcatgatagatggtgaaaagaagacgtgatacagagttagacagagttcaacttagactggctgaaacagtaagtttgcccttaactatttaaccatttgatttttgaaaagttgcttacctctctaaatctgtttttggtttgtttgtttgatttataaataggaatgataatacctatttttcaaagcttttgtaatgacaaaaataattcatatggaaatattggcattatgcatgtcactgcaactgatcaattccttcagggctatcatcattcaggacacagtcctagggtgaggaaattaacctcagtttgagttcaaatgacaaatatcaatttaataaaacaaactcttttcatttcaggaaatgttgatgttcacattagaaaaagggtccagtagcatttggaaaaatgcctgcttaatattactctatctaagctttgttaaactttgtattttagtaaattactcagtaaagtttgagcatagtggagcactttctcattgaattaaaaacattccatttttaactgtaaacacacgttctcaatttactattctccataggttaagacatttattaattataatctatactaaactattgaaagagatgataaaggaatcaaagaaattccaaatccctccagaaatgatttagtctttttttcctgactcaagaagccaaacttattactctacaaatagctttcactttagaagactctaactgaatatataaaatctattaggtatattatcatttatatgaaaattttattgtgttcagataaaatgtgcacttccaatcttactagaatttcctcctaattaaataaacatatcgctggcagattcaaataatttaaaatgttttgtttcagacatataatttttaaataataaaaactttctaagctttcaaacaaggattttacacctattacacttattttatttctaggaacagaggctaaaagaatgcatctcccatttttaaataatcatatacatatgtgtgtatatatatatgatataacgtatcctgtacatatatatgtatgtataggacacattaaggcaactcaaaaattaattttaaattcttcaatctaaaaacaataagaaacattgttccttacaaaagtgctattttattaggctaacttggtctatgtaataaatgtcatttgtagtttagagcaagagtgatttatagctagaaagatttagaatttagtttttgtaaataattatcttattatgaagactgaaactatttgatatttatcaaaaggcttcaggaatattctgctgccaaacacacagattcctcctttgtgagtgatgtttgttaatatattaaatgaagtcatttcggagaatatgagatatgcacatcattcatgtattcattcattctattgtttatttgctacatatttattgagtgacagctatgtgttcaccatggctctaaagaatgggatatagcaatgaagaaagaagatggtggtatgcataagtagatgttcctattcaagtctaaagaacatgtcgagctcacattgaatggtgtatgatatacaaatatacctctcagaacacaaaacattttgcatatcaaacctgtcttccaggggataacccttaagctaaagctaaattaacaaagtaccaaaatatggagtcatttaaattaatttggttgaaaagttggtcatccaattatattatatcatatagattgaattgtagataaattgaaagctagtttttttgttttatttttaatgggacatggtgcaccttagatttggtcatcagctacttatatcatgtttgactttccaagcttcaaatctggtaccctaacaattggaccagttctataaacttactcctatgtaggatgatattaatgttttattcagtttaaataaatcttgactctcctatgcttaacaggatttttcaatacattatattttggagctggcattgtataaatatgaaaatagtcacataccgctgattctggctgtttggttagcttgagaaatgaactgatagtcacagaaatttatatcattgtcattaacttcaaacacttgtaagctactcaacttctggtagcatggaagtgttgtatcagttgtataggactgttaagccacttttaaaaagtctttgatctgctgggcgcggtggctcaggcctgtaatcccagcattttgggaggccaaggcaggcggattacaaactcaggagtttgagaccagccaggccaatgtggtgaaaccccgtgtctactaaaaatacaaaaattagccaggcatgatgacacgcgcctgtagatccagctacttgggaggctgaggcagaagaatcgcttgaacccaagaggcagaggttgcagtcagccgagatcatgccactgcactccagcctggagacagagcgagactccgtctcaaacaaacaaacaaacaaacaaacaaaaagtctttgatcatatttgtaactaaaaattaaagactctaatgtgatataaaatgaaatgaaacatgaaaataccactttaacaaataacccagtataaaaagaaaataaaagaaaaactagctaactgactaagaaaattaattctttgtatcttaaagggtagttggcagtgggtcctggctaactgaagagcagatacagaactctggaatactgaaccatagcatgaattgatacgaactgcattttggctataatcatattagcacatagaaacaaaagaaggttggacagagtgcacagtgatctctctactatagatcaattttgtaggcttgcttctcctgttgatgataaaataaactgctcttattctatgatgaataaacccacaaatactccaggacacttagatgggttgaggagtaatttaagtatgtggtccacttgggacataacagggtatagctagtgactgctctgtaaacatagctgtctgggaagtggaaaacactgtgatgcaatgtgggctctgaaggacagtatctaagttaagaaaagagcagctatatcacaataacacaatggtaccttagaactgattaaatgataaaagtcatctagttcaaaggaagaatgagaaaggttattgcacagtaggtggcagagttagaaatgaaatgctgctctggttctcaggcaaatattttaggcccagactcataatttcattctgcaatttatttgtaagtttatttgctagacattgctttatcatttttcaaagattgcaaataaaagcttagtatcaattaaataaaaatatttgattcctaaaacagaaattaaaagaaagatagttttgtacaaaagtgcatatttcctcaacaaaactctcagtattatattaagaaaatcacttagcagggatgaaagataaaaatgtatactatcaatttacattaagagatataacaagagtgtgttatatatataagagtgtgtttaaataactctgtccgttatttaaacagagtgagaaaaataatggttttcatcagctctaaaactcatggaacttctctctgaaaataaaccatgctgagaagcctttaagaagttaaatagcagaaactctcttgagaagtaaatgttaaaattatggcaatatcccttagagttttcacttagaattaaagcttttcttttctttattttaaaaacttttatttcaggttcaggggtgcatgtgaaggtttgttacacaggtcaacttactggcatgggggtctgtagtacagatcctctcatcaccccggtctccagcctagtacctaacagctatcttttctgctcctctccctcctcccaccacccaccctcaagtagacccaagtgtctgctgtttccttctttgtgttcatgagttctcatcatttagcttccatttataaatgagaacatgtggtacttggttttctagggaactacatttcttctatacctttgtcatgttgtaaatctgttttattatattgtgtgttacagttcttagagcaaatttcctctgaatgccgtgtgatgtggtttcttgccaaaagggaatgtttaaagtaaagttgagtaaatctagtttatcgtcatgcatatcaaaacactgcctagctctgataacactcatctcacttctttcttttcttcctctaaagcgtcattttgatcccagtgttgcaaaaattaatgttctaaattcatattccctattgtgttttgtatatgctgtaattcatctagttttcaacacaatacaggttgtgcatccctaatctgataatcccaaatccaaaatgctccaaaataacaactttttgagtgctgatatgatgtggaaaattccacacctgatctcacatgatgggtcacagttaaaatgcagtcaaaactttgtgtaatgcacaaaactattaaaaaatattgtataaatcatcttcatgctatgttcataactgtatataaaacaaatgcatccctggttactcctgggcctcattctcaagggatttcaatacatatatatgtaaacattccaaaatccagaaaaatataaaaatatgaaacactcctggttccaagtgttttggataagggatacttactctgcctggcttaattgagtgtaaagtctttgtataaagagacacaagagatcacagatggcaggccctgtgggatgacatctgaagtgcactgattgctagggctggaagcctgagactagacacttaaatttttcctgtgctacttggtagctctgtaaccttagagctagtcctttttgccatcatgagtctcagtttcctcgtgtacaaagtggcaagaataagtgaggaagatatctgtcctacaagttttataacgtttttaatgaagatcaatgcagaaagtgcttaataaatctttctgttgatgttctcactctcatatttccccccacattcaacctagttctattgtcaagatttacacatctttttgtaaaatctaaattgctgtagaaacatagggtagtgttattctatccggcaatgtgccaggctgctatgcagggctttgctactggcgagcttttccttttattcagtttggtacacagagaggttccacaatgtcaatgattattatttttattcattttaaagacagtttcacttgtgaaacatgtaaccaacactctgtgacttcactaggatcacaataacctgaactttgtttatgaatttaaaagtatctttcatgagcaaatataattattctggtgaaactatgtgaggaccaaagtcactgaaaagtttatgacttactgtaactgtaagaatagaaacacaaatttggcacaccagtgcacattatcagtttttaaaagctacattttaaaaataaatgtataataactgtgggatctgcactgattggacaggaaatgtataatgaaacatgactttggaaaaattacagcatgcgcacccattgggcaatatgacatgaattacaaatattacaaagtgaattcattctgttgttttctttttcaatgattacttattctgtcatctgttaatactgatcataaattgtgtcacttccaggaaagtttctctaattacaaagtgaattcattctgttgttttcttttcaatgattacttattctgtcttctgttaatattgatcataaattgtgtcacttccaggaaaggttccctaataaatccagaggaacaaataacactctcccaatgaaagcttgttttactccacagtgagtcatcatggacatgacctttctttcgccatcgtatgaaaagatgtgcagatattggctctgcacttccacatccagctaaatccctcctcagctctgaagtctggctacacaaatctgtaaccatcttcttgttccgggaactcttgtggcatggttgtctaaagtacatagttgatcaaaagcatatattaacttaccttgctttgcatctttctaaatataaattctgactacatctaggtgtgattctcttacatctgatacttctctgcaacttttgtctcagcatagtaaccacctaattgggccaacatacaaatccttgaggaaattaatgaagaactgacggttaagaaaccttcctgataatttaactcttgcttccctgaacagattcactcctttcacgacagggaaggtgttttgattcctctaatttcttcagtttaacacactgatagaccagagggacaggaagaaattgtttaataaatctctccatagctgtcctcgctctcacatttgccctcacactcaaccttattctactatcaagagtcaaaaagtgccatcggcacctggctcctctacctccttgtgatggtccctgtcttcagttggagcaatcaattaggaaagctcatatatttcccttttcaagtaactgataagatcttatgaggcctgcctttctctactcctgttagcaagtaattaactttggaattacgaaacaccaaatccccaaagggcaacaataacaaccacagaatgcagccaaaaaacatatgaaaaaatgctcatcatcactggccatcagagaaatgcaaatcaaaaccacaataagataccatctcacaccagttagaatggcgatcattaaaaagtcaggaaacaacaggtgctggagaggatgtggagaaataggaacacttttacactgttggtgggactgtaaactagttcaaccactgtggaagtcggtgtggcaattccttagggatctagaactagaaataccatttgacccagccatcccattactgggtatatgcccaaaggattataaatcatgctgctataaagacacatgcacacatatgtttattgcggcactattcagaacagcaaagacttggaaccaacccaaatgtccaacaatgatagactggattaagaaaatgtggcacatatacaccatggaatactatgcagccataaaaaatgatgaattcatatcctttgtagggacatggatgaagctggaaaccatcattctcagcaaactatcacaaggacaaaaaaccaaacaccacatgttctcactcataggtgggaattgaacaatgagaacacatggacacaggaaggggaacatcacactcaggactgttgtggggtggggggagtggggagggatagcattaggagatatatctaatgctaaatgacaagttaatgggtgcagcacaccaacatggcacatgtatacatatgtaacaaacctgcacgttctgcacatgtaccctaaaacttaaagtataataaaaataaaaaaataaaataaaaataacaaccacagaaacccaaaccaaacaaagaaaacaaaaagccccaaagatcaacctttcagcctgaggctgctcataatacacattgcaaagatcttcattcctctcttaaaaatgtaaaagagggaaatgacacaggttatttaacatattgtccttgggctttgatataatttgcttgtgaagagttgataggcaagacctgttttctaattaggtaaatttgaaaaagcccaaaatgagctaatctcgctggttctagctgaatctttggtttagctcctgagttgctggaacttgcattctaatttagttctatcttcccagtaaaactgtcctgagaggtcctggactgtcgccccacagtgcaatggtcctaggaaagtgatagggcaccaaacagcttcaacacctaccaaatcagttagcggaacgttgcaattaatggtcctttcctaaagattaataatgaatatcagtgcattaagacgtagattatcttttgtacaaaaaaaaaaaaaaacgcaacaaacaaaacactttccttttctaatcttatgcaaatcctccagcattctaaaggcatgctttataaagtactgggatacatatcgaaaacatttcttagatgctttaaataaattctcccttcatctgagtcttagaattcatctactaattactttaataatttaggaggcttggatgaattgggaagggctcaaatttatattcacccaaaggaaatatggattaagaagattgctttcttatgggccttttctccagagatagttgtctgaattaaggatgaaaatgtcaggtcaaactcatttcttattacaatctagcaatctaaatggcagctgttgagatgagtccagagagggttacattcagatttctaatcaagggaacacctttattgactacttaataatcaattcttcttcgcatctctttaactttcaggggaataatttttactagattaaagtggtcacctctttttaaagtaactttgaccctaggtatagccacccctcccgccgacacacacacacatacacactttggtattgagatctattttagtgatttatctatctacatagcaagctgttcctcccaaaaagaacagtatacataatggaaaagttataaatatatacatcaatcattttcctcttcagagcatagttagcatagttatgctttttaattctcctttacatttccttacctaactgaaaaggctacaaaagtaacttactaaagaatctcacatacacatacatataccaacagttcctactcttaggtagaataaagaaaaaaagttatatgcatctttcaaaagaagtaaaagtaagtcagagagagagtttctacttttagttagattcaagaaaaaattacacatacttttaaaaagaattcaaagtcagtcagagaaagaaaatgtccaatcgaaaagaaatacattaaaactaaagacagttgtaatgtctccttttttatttctgatgttgtttatttggatcttctttcttcttttcttggttagtctggttagtgatttaccaattctgttatcttttcaaaaaaattcttcattttgtgatccttttttttcaatttccattttgtttagttctgcttttatcttcatcatgtctttctttctgctaatttggggcttgttatttcttgattttctagttatttgtggtacaacattagattgtttatttaaaacctttctactttttaaggtaaacatttactgatatatacttccttcttagtattgcttttgccgtatctcacacgtttccattttcactatttcaagaaatgttttgatttccatcttaatttcttcattgacctaatgattgttcaggagcatactgtttagtttccatgtatatatagtttccaaagttcctcttggtattgatttctagtttcattccactgtagtttgagaagatacttgatataatttcaacttttaaaaatttgttgagacttgttttgtgggctaacatatggtctatcaagaatgttctatgcgctgatgagaacgttgtatatttggcagttgttggctaaaatgttctgtaaaggtttgttaggtccatttggcctaagtcagctaaacagaaatacaaaagatcaccagagactactagtaacaactacatgctaacaaactcgaaggcctaaagaaaatggatacattcctaaaaacatacaacctaccaagattgaatttagaagaaatagaaaacctgcacagaccaataatgaatagtgagattgaaccagtaataaaaagtctcccaacaacaaaaagcccaggattagatgaaatcattgcctaattctaccaaatgtataaagaagaactaataccaatcctccccaagttattccaaataattgaagacgaggaaattcttcctaactaattctatgaggcattctatgaggccagtattatcctgataccaaaaccaaacaagggcacaataaaaaaagaaaactataggcccaaattcatgatgaatatagatgcaaaaatcctcaagaaaatactaccaaaacatattcaataacacaacaaaaatacaatacaccataaccaattgagatttataccagggatgcaaagatttataatgaggatgtgtgaatcaatcaacatgatacatcacataaacagaaagatggacaaaaaccatatgataatctcaatagatgcagagaaagtatttgataaaatttcatatcctttcataataaaaactctcaagaaactaggcattaaaagaccataccttgaaatagtaaaggtcatatatgattaagccacagctacacaaatttaatatttaggaaaactaaaagactctaccaaaaaattattagaactgataaacaatttcagtatacataatggaatactaatggaatactatttgatcataatacaaatgaaatcatgtcatttgcagcaacatggatagaactggaggtcatgatgtcaagtgaaataagccaggcacagacagacagacagacaaattgccacatgttctcactcatatatggcatctaaaatactttatctcatcaacatactatagtaatagaataatagatactagaggttgggaaggtgtgaggctaggagaaagaaatgaagagaggttgggaaatgagtacatacagttatatagaagaaataaatactaaagttcaatagcagtgactatagttagcaacaatgtactatatatttcaaaatagctagaagagagaacttgaattgttaccaacacatagaaatgataaacactcaaagtaatggacaactcaaaactatgacttcattattattcattctatgcttgtaacaaatacaagtacaccataaatatgtaaaatactatgtatcaataaatgaaaacaactaaagacaaaaataataacttatttaaaaatgagtctaaagaagtgtctgacacaagttctggggagctaacgtacaacacgagtgatgatgatggatgtgttactaaactggattatcataatgattacaaaatacatgtatatatggaattatcgtgtggtatatcttgaatagatacaatttttacttctcaattaaatattttaaaatataaacaaaaagcaaacaaaaaagagatgactgacaaatgcattctttgcatttgaagatctacttaattgtaagaattacttatgatgtatacatcataaacaatgtacagagtagtacacaaattacctttgacacatctttaaattaatttaactttatatatttcgaggaacaaatagatattggacagcacaaatttagtcgaaaccctataatgtattatagcaacttgtcttttgcaagagtatagctactgagtaatattttagcatatatgtttctactaatttaacaatttcaaaactgaacaaaagtttaagtataggctatttgcttgtgtattgtccctcccaccctgtaagagcatgcttagtgtaaatgaaaaaaatgcatttggctactcagattgcattgaaatttgaagctgaagagatttgttcttttcaagaaacaactgggtatcaaggttcccattagtcttattagacttttcctctgcactgtatactgtggacccatttactaactgacatggggtaaaatgacaaattatctcattattaatgaaaaaacccataaaattatttccatatttaaatcacttgcaagattacagttcaaatgacacaatagcactgcacaatttaaactcaaacctttctgtaaagctgaaaagcagattaaatttgaataattaattttaatgttttcatttatatgtagtgcattaaaattttacttactctgagccattaaccatggactgtaactcaatttctaggatttagagattatttcagcacagattagctttggtatttataccaggcaaaccttatcagaggcaatgcaaaatttgtaagtatacttcattcttaattggcctgatgcagcatgctatgactaagcagaccattcatagaaaatcgctctccaagttattgtatttattttctggaaaatattctttgttcattaaatttcaatcactttttaaatacaacctggtactttgacattactgttaatagcctatcttaaaatcaaacatcatttagaacaaccaagaaaaatgttttaataagcttcctttagcatcaagtgcctcatttgctctttccttctgtctagtaatacatcaagttttcaatcatttattaattcatttaattactatttgctgagcacccattatatatagggccctgccccaggtttgtttcagggtataaatgtgtaagtgcaaaacctagtcctgttgtcattgaccccacagtaagggtgacatggtataaggcaggcagcgtggtaaaagctggagtagggagaaagggcactgacaaggaatcagaatccaggagtttctatcatgaatctctgacttggggtccaagtagaagaaaacctcagtccataatagttcaaatatttagtgaaaattagtatttcacacaacatgaaatatcaaaatacggtagctctagggttgcttaattcaggggcccattagcacccttaagaacacaacttctttctattttttttttcactctattaccttttgagtattgacttttatctctctaagtagcttccttcaatattccaagatgactgacaaaatttggggcattaagagccaacatgacaacgctcaacctttagtattcaacaaaatgacatttacctaaagaagagctatctctctctctctccctttttttcctttggaactccaacttttagcaaggaaacctttcccagaagccctccagtagatatttttgtgtcctgttggcaagaaatggattatgtccccacccttaaatgtatcccttgaaatgagtttaccttgaaggacttgacttgctgcagtgacctcggctaagcaactcaatctctctaaacatcagcttctttctctacagcattttcctctagtccaggggtccccaacccctgggccatgaaccagtactggtcagtggcctgttaggacttgggttgcaacagcaggatgtgaatgtcaggcaagggagcgaagcttcatctgtatttatagccactccacatcactcccattaccgcctgagctccacctcctgtcagatcagcagatcatcagactgtcactatctcccatcacccccagataaaactgtctagtggcaggaaaacaagctcagggctcccactgactctatattatggtgagttgtataattatttcattatatattacaatgtaataataataaaaatatagtgcaaaataaatgtaatgcacttgaatcatcctgaaactattcccaacccagtctgtggaaaaattgtcttccactaaattggtccctggtaccaaaaaggttggggtccactgctctgcttctagtactacctctatgcacccatgctactgaagtcatgcacttgccaacagaatcaaagataaattatatgaaagcaattatgccagcataatgtattaggcaaatatttggcatcatgattgtatgtaatatgattatatgtaataggatattattttagggatactctaaaaccatgtacacacaagagtgggcctttgccacagtgagtttaaagtgtgttccttgcagcctttgccacatcactaaaaatgggcaaatcatattttcttaaaggaattaattgggactgaacaatggctcattgggtttgggtttcttgcctgaaaaaatatgacataaatttggtttcataaaaaaaattctgttaccttgctactcaacgtgtggtctctggatgggcagcactggcatgacctggggactggttagaaatgcagaatatatggatttctttctcactccaggaatatccaagatgatctcactaaaggatgtactgactcagaatctgcattttaacaagatgtccaggtaattcatatgcacactgacttttgtaggacaccactgttggagaatataagatttctgttttgatcccacagatattttaaatctcactatttcattagaattatgctaacattgatgctttatgaaaagagcattttctgaagcaaatagcactgagccaatttaattatttaatcaatttccttttcagagaatatttgtttccatctttcttttttatcttcataaaattatttattccatgtttcaattttacaacagagattcagttcagtcatcattttttttcatggagttttactatttaaccttctgcctctgcatttttcttgtgggcatttctaccaagttcaattttcttggattaaatttattaggtctaacttttttcaaaatatttgattattcttttaatattcagtcagtacaaaattttgctatctctggatttagtcaaagccaatcttattttcacttgattatttccaactgtaattttcaccgtgaactaaataaaatctgcttcaaatcatttaaatagctgcaactattttgatacatcatctactaagttcttaaacagaaaaaccacgccttatcttcattaggctcaaaatgtctcatgtaagaatgtatcttgtccagcactttgggaaaccaaggcaggctgatcacttgagcccaggagtttgagaccagcctggcaacatggcaaaacccgtctctacttaaaaaaataaaaaatacaaaaaattagccaggtatggtgacatgcgcctgtactctgagctgcttgggaggctgaggtgggaggatcacctgagcccaagaggcagaacctacagtaagttgtggtggtgccactgcactccagcctgggtggtgggctgagaccctgtctcaataaacaaagaaataagtaaatataaagggacatatcttgctttagctctggtgtcctttgagctcaagctagattacattagctatgttatatacaatataaagacattaccatggagaacagcatgtgtcgcttactataagagtgtctacaagttaaaatactactgaagtataagccccaaaagggtaatctatatctcattcatgtttatccccctgtaagaatctgtggtgcatcacaagtgttcaaaacatttgagttgcagagagagattacaaacacagcagtcttcaaacatatgctgtaagaattcagagaagggaagcttggtcctatctgtgtttctagatagttttcatgtactagttggcatcccttctggaaggtatagcatagttcaaagatggagatggaaatgtctagtgctttttatgggacaccatccatttttattttattttattttattttattttattaagtgtaaaattcttatgagatagccttgaaatgtaaatttgggaaaatagggacactttgaaggggaatctgagcatgctgatcagtgagataattgatctggtagcgaagtgcttattatacaggatagacagcagggagtgggatgagagagggaagtggtaaaaaactgatagtgtaattagtataaatgatattgcagaggcaatatgagtctgaactcaaaaaagaaaatctgaagtgaaataaaaagggtggatcctgaagacactttgtaatattggtgcccctgacccttgggcctcttgtttccatgctgtatgttgtctctgaggaatttaacctttcctcaaagtatttgtctactctttcctgaactgtggacaacactgaattcacttaagactgactcctgggcatttctactaccatattttatatgaactccagtgtcccaagaataatcctccacgttttttcctaaattaagatttctttttttggtgactgcattgtgaaatgtaataatcggcctcatacactactatccatgcaggactatcaattttatcatgtaattccctcccccatttttttcctgcctattcctactttccttgctttactcaggggcttattatttcccgtctgcctttatagtattttcctaactggtcttcctgtctagtgtctccatcctccaagtccattcttcacatagtagccagattaatcattctggattgcaaatctaaccatgtcaccctttgacttaaaatcttccaatggttcctaaatcttgctttcaggaaacgtagtgagttattattgaaaaggcaatatgatttagaatcagacatgtaaacttaagtcttgattctaccatacgttagtcatatggccttgagcaagctctttatctgaccctcagtttcaaaaaatttactttatctaagactattctgaaaattaagtgaaattatacacacatacacacagacacacacacacgtgacataatcaatggatactttattagaaaatgtttaaacttcaaaaaaagtccaaagttttctgataatctaaacatacaaacacatatatgtatgtatatgtgtgtaaaatatacagtcacacacatgtatatattcatgtaaacacggagtcttaaatatatatatatacatagatatactagtatatataatattgctttgtacaatctcaaacttgaataagattcatgatatggtttggctgtgtccccacccaaatttcatcttgaattcccacgtgttgtgggagggacctggtgggaggtaattgaatcatgggggcaagtctttcccatgttgttctcatgacagtgaataaatctcacaagaagaggagttccagctggatgtggtggctcatgcctgtaatcccagcactttgggaggctgaggcaggtggatcacgaggtcaggagatcgagaccatcctggctaacatggtgaaaccccatctctactaaaaatacaaaaaattagccaggtgtggtggcaggtgcctgtagtcccagctactctggaggctgaagcaagagaatggcatgaacctgggaggtggagtttgcagtgagccaattgcgccactgcactccagcctgggggacagagggatactccatctcacaaacaaaacaaaacaaaacaaaacaaataaagaggagttcctctgcacaagttctctctctttgcctgctgccatccatgtaaaacatgacttgctcctccttgccttccgcaacgattgtgaggcctccccagccatgtggaactctaagtccattaaacctctttattttgtaaattgctcagtcttgagtatgtctttatcagcagtgtgaaaaagaactaatacaatccatccatattgaagtcctaagtgtagatatatacatatttacctttcatgaaaaataatagaaataaaagcataaaaatgaaaattccctcaatgcttttatcaaagggagtattaaactttcataaggctaagttatacgttcactttgagaaatttaaccctcaaaagggttaagattaagcggataatactgaaataacagcaagaaaaacttctattatggcaggctgcattaattaaagtctgtatctacaagtcagaggcagggacatcctcacagggcactctactcaaaatgattagaacatttatggagcattgtatacaattctggagacaacactttaaaagatctatttaaaaaattgcacccagggaaagataaataagtttgctaatgataccatattctatttcaaatgcaagtacaagaaagtggcaagaaactcagaaaaactttgtttaaggaagataaatctaataattagaataatccagcaatgaatggagttatctgattgaaattatctgggtacaggctcgatgatcatatatctctaaaggtcatgcttaaatgactccaaacatcaggacttactcggatttgaatgacctaaaagtccctttctaaaacaatgatgtaattttcagacaaaaagataaatgcagtgcaacactagttatggtacaaagatacttttgtttttcttttgtgtttatttgtgcacttttagttcagaagtggtttttaaatctcctatgtagcacactttataattacacatatctttgtgtatctaaaacataagttctttaaaaattaattacgtttctcagaaagatcaaagcattgatctacatttttttcatgttcaaccttgtaacctttacttcacaaacgttaaacatgaggttaaatggtgttccttaaggagtaaatgcatcaggagttattctaaaaatgtcttgtctactaagcaaagcaattttccaagatacagttgggatatgaaaaaatcgcacaagaacatgtatactgaatttctgtttattcctagggctgtatttatactgtcataatatagaagaatttcaaacatactaatttaaatgtgtatcttaaagtaactgacagattatgctgcaatgctatacattttcagaattggtatcctagtatcaattctgaattctataatagcagactcacaggggacctaagggctgggaagcaatcacagcctagtgagtggtgttagcctacacctcctgactgccttcctctcaacttctcacacaaccttgaccgttttcagattctcccacgtcttctggcttcagtacacttctgtatgcttgactagagtcagtcattgtactagtgtgctagggctgccataacaaagtgccaccaactccttggcttaaaaaaacaacatttttttttctcacagtgctggatggaggctggtagtccaagatcaaggtgttgccaaggttggtttcttttcaggcctgttactggcttgtgaatggccatcttctctccatgtcttcacatggtctttcctgtgtgggtgtctgtgtcctaatctcctcttcttttaaggacactggtcatattagacttgggcttaaccttatgacatcattttaccccaattacctatttaaagatgctatctccaaatataatcacattctgagatagttggggttaggacttaaatatataaattttggggcgacacaattcagcccataacagtaacaaatagtaatacactaagctgattttttaaaatatgaaataagtaattgtttgacatatttttcaagctttgactggatgttttggcattaagaaattttgctaaattcaaaaagatggataataattttttactttagaaaattgtattttcagacaaattttggatacatttttgtggctgtgacttagttggtaaatctacccatgcaacacttatcaccagatgttaaggactaaatgcttagttttctttggaaggtaattcggtcatgaatgtggagtcttcatgaatggaactggtatccatgcaagaagagacacgagaggttcctctttctctgctgtctaccatgtgaggacacatcaagaagatggtcatctaggaaccacgaagagtgtcctcaccagaaccctaccatgctggcactctgatctcaggttttccaggatctagaagagtgaaaagtaaatttcctttttttaagtcacccagtctgtagtatttttgttatagcagcccaaactgacaaagacaccagacaagctctaactaaaaatgacacaaaagcttttttaataacttgaaataatacagagggatttcagtgtaatttccaatatgctggatatgttaccacagaatctcgttgaaggctccatgagccataatgaagagaagcacaaaagtagtatttgaaaagcatacttgttctcgagacaggacaaaatcagtgttttcattttcttatggaagagtttctcagaaaagaattcaggtaagatagctaaatgccattccccatttaattaaaaataaagttttatctgaaatgaattaaacacaactctgtttaattaaacccaaaacctttaagaggatcactccagtaagatcaattaacattctcttccatattgaacataattagaatggcaattcttgtaatccactggcataacctttaaaacttgcttggtctttaaaacatatgtggcatttccttaaaaatccaaacagctaaatcataaaaccacatactaagtttaatgttagtgctcattttaaaattaaaactattcataaaatagaactattaaatcttatttgacaactggtatttctgagttacttgagagttctgcatgaaaaataggttccaataggtgaaataggaaaattagatcttaaattagtgaactggcatacagagcaaatataagatgaatttgaatcatcacattctttttttttaaataaactaagtttcctgtcagggtttttaaatatttgccttaatttatgagtcacacagcttatgtagacatagcaaaattttgttaatgccaataatagtttggaagaaaagctttcattttcaagcactgttctgaaacatccaggaaaatctgaagaaacagaaaaaataatattaacatgacctttggccactgctactttgtgatatggtgattactaatgggactttttaaagtatgccttacactttcagaattatacatgatatcatttgctaccaatatttggcaatatttgccaatatgctgttatgtttctcccatcaaaaataaaatattttgaaatatgctctatatgaccagagagtggttgagaagatgtgcaaatgtaacatccaacagtgctcagggacttccaagaagtttggccttgggcatgctcaccaaggcatggtagagcttcagggtcctcacgtttgaatggcccctctgttggtttcaaaggccgtattttcaagtcttctggctgtcagcccaacaggtatacccatcaaggaatttccaagttgtccttcagactctctgctttacataatttgcttctctgatccactattccagtgtaggatgcttctctggagatgacaactcctaactcctatgctttctctactacttccatgttgcatggctctgcctcttgctagtttggtcattaatttcaacttgattatttcctgatcaagaaaataactttacacatgagaaatcaaatcacttgaccactgaggattagtaatttattttcttcatctttgccatacttaaattttttttctaacgtaacttcaaaattgttctagacaatctacaagacacatagaattcaaagatattaaaatactaggccaggcatagtggctcatgcctgtaatcccagcattttgggaggccaaggcaggcagattgcttgagctcaggagttcaagaccagcatgacaaaaccccgtctctacctaaaagaacaataaaattagctgggtgtggtggcacacgcctgtagtcccagctacttgtgaggttgaggtgggaggatggtctggacccaggaggcggaggttgcagtgagccaagatcctgccattgtactccaacctgggcgacagagccagacattgtctctaaaaaaaaaaaaaaaaaaaaaatggaaaaaagaaaagatttggaaaagaaattcaaagaatctggtgtgtttctggagttctggcacacttctctgtgagctgccagctatcacctgatagttacactctgtgggatatattaagttagtgatctggactctgagttgtatgtgacgttacactttaatatgacagttagacaacaaagataggaaactcttcagggagggaatagggggcactagctggccagtggctgtgatcaatccaggacaaagcagggcaagattctgagctcacaggaaaaactccagattgaactggtggacataatatctgtgtgtagctactgcatgtaattagaagaccaaaattttggtagataaaaaggctttggcattcaaatttactcattttaaaagagtaatttgtcatgtatttcctaaatagttgcatcaattttactaaaattagaagagccacacattgcaggtgcataattacacttgccattaaacacaaacacagatgcacacaacaaaattagatgcaatcatttcattgagaaaagaatgccactcctttctcattccacagtttttatttaaaaaattaaactaagctttgatttttctcaaagactgaaggatatgctgtgtgtgatttttttttattttgtccacattttaggtgggaattagtgatgaggttattctagaataatggaaactttatgcaacagtaggctaggcttccttcagtgtagtcatgaaaataatcactatatcacagtcaactctacatagtagacactgcaaaaaacaaatctgtcttcgacccatcttagaatggcccttgctataattttacctaccatatccaagtggggaaaaagacaagggagggtgttcattcattggttatgagcctagcagtatggttacacctttcatagatgccatcttatttcagttctacaataatcccttgaggtaatgttggctccattttttaagatgaggagtcctgggatggtgaattcatagatccagctaataaggatagtaaaatgcagagctagaaatttgaattgcagtaatttggatctagtttggtattttacctcctcacccctgggagatacgttttctctagtctaagccaggctggccatgtcactgatatcgagtctcacggtataaatcctgtaggcctaagtgagtacatttcttctagtatttggacttttagaagacaaattttatgatgatttatcttaaataaatttttctgggacattttttgtcatagactgtaagaccatactgatgtttttttaaaattgagattaaaaacttagaatgtttttcaagctaatacgactttgggaatgattaaactgaattccacatcagaattctcactagtattagtcctagtaaaaataattcattggagtatatatatatatgaataaagctttttattctagacttgatgcaactttagcggtaccagggagcaaagttcatccttatgtcattataatgactaaatcttagcaaagatcctgctgattaattcagttttctcatggtaggatcataatttcatttcccttctttccaattcttattgcacaaacttttcagttttaatattaaataatgtattttaaacttttttagctagtggattaagcaataaaaccagttacagttttaaaaataatggtgatcccttaaaattagattcatttaatccattgtaaatagttatgtgaatatttcttgaaatggggtcactcattggtataactattgtattaatattctacatttcattttactattatgcaatcactttatttaaaatggtatgcggagtatgtgggttaatgtaacaaaagttcctatcaaattgtaagaaactaaacttctttcagtttctcaaacatattatactttcttttacttcttggacttcacataagttctttctggaacttattttttaactcaatcttcctattcctacttgtagacacaactaagtcctgatcatattttaggtttctgctcaaatatcctttctcagtatatctttctgaattctcagaccagatctctggtttatgttctaagtaagtcttctaatttaccagtatacacattttaattttatttcttgtttatagctctgtgtttattggctataaactttttaagggcaggaaactattcttctgtcttcatttctggacaccagaatctagtcctagaattcatgtgataaacatctgttgcatgagtggtaagtgatactgagttatattgcaaacgtgcaagtttggttaaaaatctcataggatagtgtaacaaaatcattgaaatcagaaccaatgaccactatttgtgccattccctcctgagtaacctgaatgatgatgtgtaatgatgctgaacatccaggagacctgtctcttctagggatggcaacagggaacatggcatgtccggttcttggggcaggtatgggcagattcagtgcttctcactatgaaggattattctgcactgtatctagattagatcttaataagatttaaggtcttaatgcacaactgtagacaccatactctccttctctggattcctggcaagtatcaataagaaagacagtcatatttgtttccatttgtgtgacatccttttcactttgaaaataagaaaattgtgctccagaaaagacagatcttttgcccgagggcttacaataagttagtgacaaagttgaacctttctaaacagcaaagtcaaacctttctaaacagcatattttaagacattttgttgaagcccagtagtaccttgtcgcctctgccaacaaacctcaagcaggtgggaattttaagaagtcccgcattgagcattgatatagaggtgattcaacaagtcactagggacttgagggattctagcacaatacaattgcaaaattgtaaaaccttagctctgtgagagaactgttctcatttagagctgctgagttttaatagtcactgtattcgtattaaactgcatttttctctttcctatgtttactttctgcttgtcaagtaaaagatcaatgttttggacagagaaggtgacagggttggccaagaagattttgttttcctcagctcctctgagtgagctccatctcattcaaaaacagatcaagctaaatgtgaagcaggaggcatttactgtgctccacttcccaactgccagggcctcacaagaggtaacttcagggctgcgctgcaaggctgtatgggttctgtttgcataagggtacccagctgagaggatgagactgactgaaaagcatcctgggctgcactcatcaaggtatgccccagcatcactgatacaccagaggaaagagcacttttgcacaaatgcaccctatgggtatgaagtgacccacactcactcattatcttgggctgggatattcccttctttctccctactcagctactatgattggacctgaaagttcctaaataaagctgtgtcctaaaaagcattaattggtaactttaatgctattgctgatctccccattttctttgtagttctatgcacattttgtttaccagcagaaaaaatagtaagtttgatttactcatctttggttagaaaattgcttctactttattttggagacataaaaaagtaggtaaactgttttcaaatcataaagaaaatactacaaaataaaatagatttctctaatatgttttgcatttattcgacccatttttaaaaaccacctggaaagttaatatatttatgtgatatataaacagatttcagtatattttttaaaaaaacaaagaataaaacttcctaaagagattttatactttccatatttaaatcttattagcattttaattaatgacgttatttataagcaaacactgttaaatgctgtattttcctgttgcattttttcccctaagagttgaataacgggaagaacactgtaattccatggttatgtttctgtaaacttccatggctgaacaaacaaaacaatcaccaaatagtggatagacttttctaaaacaaagtctttcaccatgaattaaaaaaaattatttgtcattctctgcctcttgttgatttgtatgatctgacagatggattaaaagttgtccattaatgtgagcagtgagcttagaaacagcaaaaggtgctgggattctcttttcttttctttctttcttgtttttttttttttttttttttttgagacagggtctcactctgtcactcaggtcactcaggctggagtgcagtggcatgatctcagctcactgcaaactctgcctcccgggttcaagcaattctcgtgcttcagcctcctacacagctgggatcacaggtgtgtgccagcatgccaggctatggaattctcttctccatttcatgctcctgagtggctctccttacgcggtaggtcagggccagtctgcacccagcctatctcccaatttcccacctgtgttccaaatgtagactccaagtaatagggagctgggagttcttggtccctacttctatttcccacaaagcctctctaaatgatcattttgtcataaattatggtgtgcttgctctacaaacacagcttaaaggaatatgtcctacctctgcctctaccttctccaagacaattccgacaagatgtacttcttaaatcctttttacatggaacttctggactcttcactgaagagctcagctgtggccagcagatgcctgactatgtatttgcatccattacaaataccttgttagaccaggatagctcccccaagggagtacctttcaaaagaaggaaagctgggcttttaaaacaatggataatctcataaggggtgctgttgttggtggtgggatgtcccagcgtttttcactgatagttaagtagagctgctgtggaaaaatccaggggtctaggtgttttttggaatatacaaaataatcagattcaaagctagggacacaaagtgtcctgttttcttatttgtcttttgatttaaaataacagagccacatgattttggataaaacttggctccagtactactaatctctagtttctatgttaatgctaagaaagaggcagggaaaataactcacatggcacttaacatccttccaggcacatgcagcatattttataggcctgataccattcagcctttcaacagccctctggaatgggcatttactatatttctcagatgaagaaattgttgcccaggggtaaaatgctattcccaatttcacataggtagtagctatggggattaagatttgagttcaaatcctaaagactgtgttttttttttttaattatatgaatccattgagctaaaaacagctttgaggattttaaatgccatccagtgacaatttctacaaactgtagacaaaagatcccaaatgtcatttagagtcattcaggggcattcctggtaactttaacccattccccaaatagaaaatattatgctgagttcctatataataaaggctactgagttgatcacctgaatttatctgtggatccaaaggattcatctgattcccagcaatccactaaacacaggagagccagaatacaaaatagcatctttaccaccagaacgaaatagagattaaaacttttgatgtggaagtcaatttaagcatatttgcttgaaagttaataaactattagacttttcagtatctattcaccaggaatagaggcacaatgcaaaacaattacagatgagcagtctgctaaaatcattatctattgaccgaaaatcatcattatatcagcatcataacttagatcaattaaatgtaccagggaaatgaaagcaaatgagatgaagtgaaaataggattgctgaatttggcaaaataaaacaagaaatgtctatcaactttgaatttcagataaactacattttttaaaagtataagtacatcccatgtaatatttagtaagcacaaacctgcacattgtgcacatgtaccctaaaacttaaagtataataataataaaataaaataaaataaaatattcaccatttataataaatttaaatttaactaagtttaactgtatttttatctggtagtcttaaagcaaatgctatatacagttttacagggaacttagtcattctaatcaataaaataatagctaacattttcatatcagttatcctttaagcactttataaatgctaatttatttacacaaccctataaaataggtactattattcctatttagcaaataagaatattgagatagtaacagatggatttgcccattgtcatgcaactagtggcagagaaggggtttgaacccagaaggtcctgttatagagtttaacactctaaccacttcagatactgtctcctatgaaatgtatcagtgaattcaaaatcctacaaattgcacatagattgataactcttgaaaatagtattcaacaccatattaacgtgcatcatgcacttactttacccaaggcctctttaacagacagcaacagtaaacttaatattccatcttcactgatcatattttctctcttcaaatggtacttcagaaattggtaatacctcatggtcattgttcagaatatctgttattgtgttacatatatcaaagggcaaaataaaaaaattgatttaaatttcataatttaattatatatataaagggtatatatagatatataattatatatatatatattctagccagagaacacttaaattacagatacgaaaacagatcttctttctcataaattttagatttgattctatatatggatgtttaatacactttatttcctacagagataagagaaattaaagatttgttgttggatttattcatttaataaaagatcaatataagctggaatttttatcctttggatactggtaccacagaatttctttaatttggagtgtcctgatactttaatcttaaattgcaattagattaatgcttaagtaatcttcaaaagtcagtatatctaagtaagtcccattagaatgggacttcaggccaggcacagcggctcacgcctgtaatcccaacactttgggaggccaaggccgatggatcgcttgagctcaagagttcgagaccagcctgggcaacatggcaaaaccctatctctacaaaaatacaaaaattagccaaccttggtggtgtgtgcctgtggccccagctacctgggagtctgaggtaggaggatcgcttgagtccgggaagtggggtttgcagtgaggcaggattgtgccactacactccagcctgggagacagagcaaaacaatgtctcaaaataaaaaaaaaaaacacaaaacaaaccaagaggttgcctttaaacgaacatgtttcaaataataaatatccaattccttttttcttgaacatcaccttgcacaagaacccaaatatatttgtccaaaaatgcacatttctatgcccaacacagacctaataacatcagaatctctggggataaaatttaagaatctccgttttcagccagcccatgccaccagctgattctgatgcaggaggtctccaaaccatgctttgagaaaatgactttgacaccaacatgtaagaagatacaggcagctggtggtgtgctttttcccactgagatctttaaagctgctttatttttagaattttccctatttctcattacagagctttaagacagcttgtagaaaatgtgtgtgtgtgcatatatatatacatatatagtatatatatgtatatactatatatgtatatatgtatatacacacatatatatgcacacacacatatacatatacttacatatatacttatatgtatatacttatatacttatatttgtgtatatctctacctatatatatatatagatatatataaaatttagtgttgcagtctaaaggactttggattcattaccgtgtattacagattttcccacatcgtaaggcatatgcctaacagaacagatgggtcctgtggtatttaacaaagggccatcaaatcctacagctttggggattaaaaccctacagtgctttttcatgaaataaacaaagattgaacctttaataggtggtaggatgttaagaatggggtgaaaagtgactcagagtttaactcaaataatagttgttccactcatttaccttaaaccctcttaaccacatttggttttgctaattatgttgcatatagaatagcaatagtaatcatatacacccaatgccataatgataatacaaccctgaatgtaactgctatcaaattttgttccatattttattttaaaactataggacaaggtatcataaaaatagaaattaataatgtaattaataatggctataaatatcactttgcttttttttcttatgatgggtaaccttgtacaaaaaccttcttatcattttcaatagcattaaaaaatagtgcaaatggaaatttttttttttttgagacggagtcttatttgtcgcccaggcttcagtgcagtggcttgatctcggctcactgcaacctctgccttctgggttcaagtgattctcctgcctcagccccccgagtagttgagattacaggtgcccgccaccatgcctggttaatttttgtatttttagtagacatggggtttcaccacattggccaggctggtcttgaactcctgacttcaggtgatctgcctgcctcggcctctcaaagtgttcggattacaggcatgagccactgctcctggcctgacactatttttttaattgaacctattctactgagtaaaagtaaacaggcacacccctgcttcctttaaattttttttatttagaggacacaaagcatgagaggagaaaatatattggatacagatatcttgttattcaaagagcctatagtatggcttgttaaatgaggaaaatctgtaacgcaaaaaataatgatgctttcatagcagagttcctattactcaacacgtgggaaagcctacaaaatgtctactgcttatgtttggtgtcccattttaaaacggtgaatatcctaatatgtattctacattaaagtttaatgtatgtcagaacctttcattggaaccagcagacagaaatttacttattaacatagagaaatgaacatagaaatgaacacagaggaggcaaaaccaaagcatgtgaatatctgcagaaggacaaactaaagttaacataaagacaagtagtagcgatgatcctctgtcattttaagcaagagaaaacagttttaaagaaagttaaatgcagtttaagaaacgggacaaaatttttacaacttgagtgacaaataagtatttgtgtactgttgtaaacttctttgaggaactgtttctcagaaagtaaaagtgttcacttgttactttccttgcttagagtggtccatgcatatgactcattttattcatgacaggggtcgactattcctcaggtatatctgggttaactttagcttatgtgcaccattctgaagatgaaattgataacaatgctttggattcatttagataatttcaaatgcttggtttacacagatatgaacaaaaaattgatgaaattgtttgttatatgaagtaggaacagaggcacgcagtgaactggaaaaccaagtttgcggatacacatatgttgtatatattgtgctgtactgaaaaaatcatgttgatgcaaaaaaaggctgttaaggttaaaccacattctatgtgatgtcagccacaggcagccatgaaaaaatggaactcaacagaaaagggagaaactggatttttgggtcaagttctgccatttgcaggattaagtcatgtaatgtcagcaaattgtatttttcatgttttgagacagggtaatttatacaaataatatgtacacattatacatgtgtatacatatgtacacatattattagaaagatacagtaaaaaaaatagaaaagccctttgaaaacaacaaagtgctatagaaatacaatttaattattacatgatattccaaagcggttcctataggatattagggtagttatttttatttttattttttattttactttaagttctgggatacatgtgcagaatgtgcaggtttgtaacatagggatacatgtgccagggtagttcgctgcacctatcaacccgtcatctaggttttaagccccacatgtgttaggtatttgtcctaatgctatccctctccttgaccccacccctcgacaggcccctgtgtgtgatgtccccctccctgtgtccatgtgttctcattgtttaaatcccacttatgagtgagaatatgcggtgtttggtttcctgttcctgtgttagtttgctgagaatgatggtttccagctgcatccatgttaaaaagcactccatgaaaaataagttagaaaatcatcaactaaaaagagttaaacaactccctttcctacaggactcttaagagtctttactatgttaatatgcatgtgagaaattaagaacataaaagaggatatagaatttacaaaatgtatttcagcccagaaccattttttttttggaattactgcttaccttatgggagtagtgattttcaggatacatcttggaaaatgctgatacaatttgttattcggagagaaagagaatgtaatttgttttaaaggactgcatttttaggacgaaattttcctaattagatcagttcaaaatcaaagcaggaaaagaaggtcattttgaaaactgggtctgtcgtcagaagaacccaaatctcgtagtggaactatctgaagaaagggtcatctggataatggaaattttgtgttgggctagtagttttggattcacaaaaaggactaggaaccaagagctctgcgggcggtagaaagcctaaggtggatgtcagctatggcagcaagctagacccatgtgtactaagaagccagaagtcgaagtggcagcagttggcaccataagagccagggcagttcctgaaacttcaacagagatgagggtgggctgccgagaaacaaccaattacccttcagggggcaggccagagctggagtgtaaagccaaagagtagatacattagtccattttcacactgctgataaagacatactcaagactgggtaatttacaaagaaaaaaaggtttaatggactcacagttccacatggctaaggagacctcacaatcacagtggaggcaaaagacatgtcttagatggccatggggagaatgagagaatgagggccaagagaaagaggaaaacccttataaaaccatcagatctcatgagacttattcattaccatgagagaggtatgagggaaactgcccccatgatttaattatctccctctaggtccctcccacaatgcataggaattatgggagctacaattcaagatgagatttgggtgaggacacagccaaaccatatcagtagataaaccaatcaacaagcaaccagcaaagctcaggtggagaagaagtcaggggaggagagcagtaagacacatatcagaaactgtcagaagtagagggcaggtcaaatggcaagagcagcataaagattctttgactgggcctgggcaaggaacctaagcaattagttcagaagtcaaaactttggttggctttaatactaaggtcacaatctcttctagtgaaaaaaaaatgtacatctattttttaaaatataaactaattccagaaagttattacctagaagctgcaagcagataaatgtgtccttagtcacatcttaaataatctcagaaaagaattttaccaaagatcaatacagaaaaggctttgtctaggtccagaagacacactatgctaaagaattataatagcggcataaaacgaacaaagacattagacatttgaaagtcacttcactgaggcatgttttccttgcacaaatgctaattgtattaattaaaaagaaatgaatgcaaaattttctataaataaattttattttgatatcagccagcaaatcaatacttcataaatgagagacatttacaatcataaatgtaaacaaaaagtgaactacctattattatagcattactggctttgaggaaatattacaaaagtctctaggataaaccaaagcaattgagccaggtgagcttaactatgagcaagctcgctggacagagcagggttctctaaaacataatgtatgaataacaaacatatcgttgggttgtgggcagaaaatattagagtttacattcctatttcctatttgttttattttaaaccaaaaatgtaggaattgcattttccaaatatttcatacatgtgtatgtgtgtgtatccaatgctcaggagcactggaagggatatacgattgttacaatgtggcaccacaaatttagagggcaagctgaatccacagaatctgcagagcctggctggacccaccaggagctcttattcaagacaagataagtgaccagagctatgctggtcaggactgggcattggagaggcttcctaatccaacagatatcccctgaaaaaaatgagtcacttcaatcattataatagtctagaaaatactgtggtaaaaatcatctcataggcttcctgacaagtgctgaatcccctttagaccactgactggctctgcaatctttaacaagcttctctgactcttcattataaagcaaacataacttagctcacggagagggctgctttaaagacaaaatgagattactgattacaattgattctaattttatttaaaagcctttacaaatgctcataatatttgaaacagtattcccaagttctaaattttactcattggcatattttcagttcatatttttagaagagaatggttaccattcttacagctatgctttgttgctacaaagataactaatacgccacaaacgaaaattcatttgcacacacaggaatcagaagtcatctaatttgcattatcataaaacaggagcaggtctgctgtgcacatgaaattcttttaatttctgtcgtggtttttcaatggtttcaataccacttctaagcagaagcattcaacatcctacacttctgtttcttgcttttggaattttgaattaatgacaattatggcatcagtaatcatacatgcaggcagacataatactgaatatgtctttcagttccttgcacctgacattgtgttttgttataacaggtgccccaaatatacttattttaattcaaaaagtataaagtcatttaaaataacctccaaaccataaaggttccatgcattttttaatgtaccactagagcttgtctttctgagattgtaccctgtatctggggttaatctatttccttctctttggcaccagaaactattactttgggcctttttcatgattttctatatgcaagcacttacttattaaatattaagtaagtatttaataatcacttactatatcttacttccttgccttatggaagtttttgttttctaagctgtttttagagagatgtaagatactaaaccaaataaatgactcaaaattagaagggatggaaaggtaggggcaatattttgagtattaagtagatgtgttattcattgtataaaagttaactttttataggtctatttgaaggttagatggctatatctgtatcaataattgttacatgactttttattagcttcatacttgtgctaccttgtgaagaaattagctggtgtcttgataattttctgatttctttggattcgtccagtcatgatttagacaccagaattttacttgtgtgaggaattttaaaaggagaagataggctggggctgatctttttttgtagtatctccattttacataaaaaaagaaagaatattgaagtctcagagtattgatataatttgtcagccctcacatctatattttgtacctcaaattatgcactccttatactacattgatattggctgcacttttgtttgcacttaagtattttctgtacaaatgtcctttcaattttgttttgtttataaaaagttcttttttctaattggatagtggggattccctttgacatcataaaattataaaaatcaaaaagatttcttattcatggtatgtggtttaaaaaaatgaaaaaatacataaagatgacttatagtcctaggaaagtgtgagcatccttcgattcacttagcacactccaacatatgtcaatactatagaagaacggaagctgtctcacaatcatatacaagtttcattacttgacctcttttagatcttctttataggtgaaccttcataaatgagaaatattggaactgtgatttggaaatcagaataatccttcatattgacaaatgtttccagtggcctggtggtcacttaattttgaaaacctttcctttagttctcctgtaaataaattgttcagaaggcaaaataagttaatgctttaatgaagttataaattttatgtctagaatactcccttttaaaaatctgacatggactaaattaaataaggcttatttaatttgaaagcttaaattcaattgatttcttatacattttcacaaaattagtattgaaatgaaaatctgtagggtcagacgcaattttgataaaggtcaacactaaaatgttcagtctaacaactctattaattctactaatttggttgaaatactatgcagactaccttaaattagcaaatgtcttatgaaatagaccaaaagatcatttcttaggtgggattgtgacattttccttcctgttagtcctttatattatgttaccctttatgaaatctgaaaaacgtttagtagatttaattatgaatagtaaattatccattttctatagtcaccaccaatacggcaatgaatacatacacaatgtattcattataacaaaatttgtagtattttactttaaaataagtttttagttaatccaagttaattctttgagtgcagtttgtttagttccgtgaacaaaaccaaaatgaatcagcatatttcttcacaattaatagcatgatcattagcaatgtccctgctcctcatagaatgtctttaagcatcttaacaatgtttaatttcaatttgtctaatctgagcagaagtaaaaaagaaattaatctttctgttgaaagccagtgataacagacacaaaaacacataactgctttagtaaaaatacagtttcagtagagaagattggcaaatgataaattactcactttaaattattactactgggtaaagaagctgaaaaatctgatgctacctagatatagacatttcaaagtttttatgtgccaatgccaatatatataatttatcaacacaacctacagtttgcaatgatttaacaatgtattattttacatttcattattttattggaaattccattttggaggaatatatatgcaaatcttcacttttgattaaaattggtggtgtcaaattctgttctcctgaggtacacaatccaccagaaaggaaaagaagggatctatccaatactgagtacctactgcatgcttccactgttctgttatttgttttatttaatccactttaagagtcatcacaatttctgacttctttgtttggaaactacctatggaagctaatagtcttaacctaaaaacatctctgtgagttaaatgttactttatttttataacaaagattaatatctatcctaaccatgagttaggaatgtccaattaggagtatggaataattggctcagaatgttccaatttcaacattggtaagaattttgaaagttaaaaactaaaatttgacctttgggaggctttcagataacacattggtaagctttattgctcaaagtattagttgaattttaaagttttacaaaccatcatacacagaggtctgagaaatgcctctgtttagggctgcctgaggccctcacacatttttgccatgtcccgatagaaatagcataacaattttatgattagcagcaactcaagaaagctaaccaattaggtaggatcacctcttaaaaaaaatcacacggccgggcgcggtggctcacgcctgtaatcccagcactttgggaggccgagacgggtggatcatgaggtcaggagatcgagaccatcctggctaacacggtgaaaccccgtctctactaaaaatacaaaaattagccgggcatggtggcgcacgcctgtagtcccagctacatgggaggctgaggcaggagaatggtgtgaacccgggaggcggagcttgcagtgagtcgagatggcgccactgcactccagcctgggcgacagagcgaaactccatctcaaaaaaaaaaaaaaaaaaaaaaaaatcacacaagaatatttgcttgagaagttccagacattttgatcttatagaagtgagtagatgaaacattagagtaataaaaacaatagaatgttaaaatgagatttgaggcagttccaacatggcagaataggaacagctccagtctacagctcccagtgtgagcgacacagaagacgagtgatttctgcatttccaactgaggtaccaggttcatctcactggggagtgtcagacagtgggtacaggacagtgggtgcagtgcactgagcgtgagctgaagcagggcgaggcatcgcctcacctgggaagtgcaaggggtcagggaattccctttcatagccaagcaaagctgtgacagacggcacctggaaaatccggtcactcccaccctaatattgtgcttttccagtggtcttagcaaacggcacaccaggagattatatcctgcgcctggctcagagggtcccacgcccacagagcctcgctcattgctagcccagcagcctgagatcaaactgcaaggcagcagtgaggctgggggaggggtgttccccattgctgaggcttgagaaggtaaacaaagcagccaggaagcttgaactgggtgaagcccaccgcagctcaaggaggcctgcctgcctctgtagactccacctctgggggcagggcatagccgaacaaaaggcagtagaaacctctgcagacctaaatgtccctgtctgacagctttgaagagagtagtggttctcccagcatggactttgagatctgagaacggacagactgcttcctcaagtgggttgctgacccctgagtagcctatctgggaggcaccccccagtaggggcagactgacacctcacacagctgggtacccctctgagacaaaacctccagaggaacgatcagacagcaacatttgctgttcaccaatatccactgttctgcagcctccgctgctgatacccaggcaaacagggtctggagcagacctccagcaaactccaacagacctgcagctgagggtcctgaatgttaaaaggaaaactaacaaacagaaaggacatccacaccaaaaccccatatgtcaccatcatcaaagaccaaaggtagataaaaccacaaagatggggaaaaaacagaatagaaaaattgaaaattctaaaaatcagagcacctctcctcctgcaaaggaacgcagctcctcaccagcaacggaacaaagctggacagagaacgactttgacgagttgagagaagaaggcttcagatgatcaaacttctccgaactaaaggaggaagttcgaacccattgcaaagaagctaaaaaccttgaaaaatgattaaacaaatggctaactagaataaccaatgcaaagaagtccttaaaggacctgatggagctgaataccatggcatgagaactacgtgacaaatgcacaagcttcactagccgatttgatcaactggaagaaagggtatcagtgactgaagatcaaatgaatgaaatgaagcgagaagagaagtttagagaaaaaagaataaaaagaaacgaacaaagcctccaagaaatatgggactatgtgaaaagaccaaatctacgtctgattggtgtacctgaaagtgacggggagaatggaaccaagttggaaaacagtctgcaggatatcatccaggagaacttccccaacctagcaaagcagaccaacattcaaattcaggaaatacagagaatgccacaaagatactcctcgagaagagcaactacaagacacataattgtcagattcaccaaagatgaaatgaaggaaaaaacgttaagggcagccagagagaaaggtggggttacccacaaagggaagcccatcagactaacagcggatctctcggcagaaactctacaagccagaagagagtgggggccaatatttaacattcttaaagaaaagaattttcaacccagaatttcatatccagccaaactaagcttcataagtgaaggagaaataaaatcctttacagacaagcaaatgctgagagattttgtcaccatcaggcctgccttacaagagctcctgaaggaagcaatgaacatggaaaggaacaaccagtaccagccactgcaaaaacatgccaaattgtaaagaccatcaatgctaggaagaaactgcatcaactaatgagcaaaatagccagctaacatcataatgacaggatcaaattcacacatacaatattaaccttaaatataaatgggctaaatgctccaattaaaagacacagactggcaaattggataaagagtcaagacccatcagtgtgctgtattcaggaaacccatctcacgtgcagagacacacataggctcaaaataaagggatggaggaagatgtaccaagcaaatggaaaacaaaaaaaggcaggggttgcaatcctagtctctgataaaacagactttaaaccaacaaagagcaaaagagacaaagaaggccattacataacggtgaaggaatcaattcaacaagaagagctaactattctaaatatatatgcacccaatacaggagcacccagattcataaagcaagtccttaggacctacaaagagacttagactcccacacaataataatgggagactttaataccccactgtcaacattagacagatcaacaagacagacagttaagaaggatatccaggaattgaattcagctctgcaccaagtggacctaatagatatctacagaactctccaccccaaatcaacagaatatacattcttctcagcaccacaccacacctactccaaaattgaccacacagttggaagtaaagcactcctcagcaaatgtaaaagaacagaaattataacaaactgtctctcagaccacagtgcaatcaaactagaactcaggattaataaactcactcaaaaccactcaactacatgggaactgaataacctgctcctgaatgactactgggtacataacgaaatgaaggcagaaataaagatgttctttgaaaccaatgagaacaaagacacaacttaccaggatctctgggacacattcaaagcagtgggtagagggaaatttatagcactaaatgcccacaagagaaagcaggaaagatctaaaattgacaccctaacatcacaaataaaagaactagaaaagcaagagcaaacacattcaaaagctaggagaaggcaagaaataactaagatcagagcagaactgaaggagacagagacacaaaaaacccttcaaaaaatcaatgaatccaggagctggttttttgaaaagatcaacaaaattgatagaccgctagcaagactaataaagaagaaaagagagaagaatcaaatagatccaataaaaatgataaaggggatatcaccactgatcccacagaaatacaaactaccatcagagaatactataaacacctctatgcaaataaactagaaaatctagaagaaatggataaattcctcaacacatacactctcccaagactaaaccaggaagaagttgaatctctgaatagaacaataacaggctctgaaattgaggcaagaattaatagcttaccaaccaaaaaaagtccaggaccagatggattcacagctgaattctaccagaggtacaaggaggagatggtaccattccttctgaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctcaataaaatactggcaaaccaaatccagcagcacatcaaaaaccttatccaccatgatcaagtgggcttcatccctgggatgcaaggctggttcaacatatgcaaatcagtaaatgtaatccagcatataaacagaaccaaagacaaaaaccacatgattttctcaatagatgcagaaaaggcctttgacaaatttcaacaactcttcatgctaaaaactctcaataaattaggtattgatgggatgtatctaaaaataataagagctatttatgacaaactcacagccaatatcatactgaatgggcaaaaactggaagcattccctttgaaaactgccacaagacagggatgccctctctcaccactcctattcaacatagtgttggaaattctgaccagggcaatcaggcaggagaaagaaataaagggtattcaattaggagaagaggaagtcaaattgtccctgtttgcagatgacatgattgtatatctagaaaaccctatcatctcagcccaaaatctccttaagctgataagcaacttcagcaaagtctcaggatacaaaatcaatgtgcaaaaatcacaagcattcttacacaccaataacagacaaacagagagccaaatgatgagtgaactcccattcacaattgcttcaaagagaacaaaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaatagcctgcattgcaaatcaatcctaagccaaaagaacaaagctggagacatcacgctacctgacttcaaactgtactacaaggctacagtaaccaaaacagcatggtactggtaccaaaacagagataccgaccaatggaacagaacagagccctcagaaataataacacacatctacaactatctgatctttgacaaacctggcaaaaacaagaaatggggaaaggattccctgtttaacaaatggtgctgggaaaactggctagccatatgtagaaagctgaaactggatcccttcctcgcaccttataaaaaattaattcaagatggattaaagacttaaatgttagacctaaaaccataaaaacccgagaagaaaacctaggctataccattcaggacataggcatgggcaaggacttcatgtctaaaacaccaaaagcaatggcaataaaagccaaaattgacaaatgggatctaattaaactaaagagcttctgcacagcaaaagaaactaccatcagagtgaacaggcaacctacagaatgggagaaaatttttgcaatctagtcatctgacaaagggctaatatccagaatctacaaagaactcaaacaaatttacaagaaaaaaacaaacaaccccatcaaaaagtgggcaaaggatatgaatggacacttctcaaaagaagacatttatgcagacaaaaaacacatgaaaaaatggctcaccatcactggccatcagagaaatgcaaatcaaaaccacaatgagataccatctcacaccagttagaatggcaatcattcaaaagtcaggaaacaacaggtgctggagaggatgtgaagacataggaacacttttacactgttggtgggactgtaaactagttcaaccattgtggaagtcagtgtggcgattcctcagggatctagaactacaaatatcatttgacccagccatcccattactggatatatacccaaaggaatataaatcatgctgctataaagacacatgcacacgtatgtttattgcagcactcctcacaatagcaaagacttggaaccaacccaaatgtccaacaatggtagactggattaggaaaatgtggcacatggaatactaggaatacaccatggaatactaggcagccataaaaaatgatgagttcatgtcctttgtagggacatggatgaagctggaaacatcattctcagcaaactatcgcaaggacaaaaaaccaaacaccgcatgttctcactcataggtgggaattgaacaatgagcacacttggacacaggaaggggtacatcatataccggggcctgttgtggggtggggtgaggggggaggtataccattaggagacatacctaaggtaaatgacgagttaatgggtgcagcacaccaacatggcacatgtatacatatgtaacaaaccttcacattgtgcacatgtatcctagaacttataaagtataataaaaaaatataaagaatgttaaaatgagatttgaatacatacgaattcccaaaggacacataagaatttcttaaactatatgacaattaggcatgagggtattttggggggctgaatttacaattgtattgccagatatctgattaggttttagaaaaacctattaaacagaaataaaactccattagagcgtcacatttttagctggtatataaaagacattttttaaaaaaatagcaagagattgataatgaaggaagggaatttaagtggcagacatggcttttcttctgaagagctactgctcagaactgatgcattttagttaaaaatatacctaattcagaggcgtctgattttataaatacattcaggataaaaattgacctctatgttacctctatataaacaactgaaaaagaaaatcaccccatacattgttatctatgaaaatgttaatcttattttcaacagaaacactaacaagcataacaatatacagttgaacagattatattctcttgaggggaaaacactaaaaaatagtcacaattctgggcctttttcttgcatgatgtcacaaaataaataaataaaaggaaaagatgtcaatttactttgccttggagattctgaatatgttttgatacaacaaaaattagacatatattagaagaactactccttgaattaacacaaagtctattatgaacacaatgaatcaattttagcatgcaagtgattttaagaagatagttgaaaaatcatcttgaacaaagtgatagatggaggctcacactgaagattatgccctgattcatgtaaaaatatttgtttaatttttatctttccaaagaaatatgccatttgcaatccctttatgtggatgtttctagagtctaccaacctcctgagctacttatggggtgtaaaatagtttgccttattccacacagcattatgactcacaaataacattagcgatacgcagccaatctgatacatgactggaatatttacaattttagaatatacagcaatgaaaaattttaagttgatcattgtcaagtctaacaagtggaaaggagattttcttcaaagtaagaacctgaaaacttcaatgatggctatatattataaaaatttagtttccttatttaaaaaaaagtcagctcttcaacaagaaattttaaatgtatcttttaaatattgaaaaattgagaatatgtaccagttggcctcttaaattgggtatcaaacttatatgctatgttggctcaaaccaataacttgaattattttttgaatgaatcattcatttattcattcaacaaatctttatggaatgcccaccatgtgttaggttagttagatgctgaacaacaagttaagaaagtcaggacaggcatggtctcagcctcttgaaacaaacagcctagcataaaaacacaatttccaatacagtaagaaaatggtatagtgacaaaattacagacgatgtagtagtatacatgataaagatttaagtcagacgtgggcagaatggatttggcagcaaaatattcccagagaaaggtatatccgaactgaagctgaaggatttaaatataacagaaggcagataatgctgtgggtagaggctctttccattcatttcttatagcaagaggacatttataaaggaatgggaagaaggagatagtacttggtttgagtacaagcaaatttagaagagtagggtaagaaacgaactggggccaaatcatgcaaaaaactcttaggttatattaaggaacttgcacattattctgaaacagagggagtaatgaagggttttaaacaggagagtaagagaatcatatttaccttttaggaaaacacagacacacaaacacacacacacacacgagttacaactttagaaatgaatttttaaagagtaaaactagaaacggaaaagctggttaagaagcttctgtgaaacccaggtgaaagagggtggtagcactggtgatagaagtagcagtggggatggtaagatgggaaatgattttcagatatttgagtcattttttcatagttgaaattaccaatacttgctaaatcagttaatgttagtgtgtggagctggtgaaagagatgttagcaggaagataattgggagaagaagtgtgaccaggaaaggacattgggaaacatctgctacgaggatggaggaaaatagaaaatggtgtaagctaagtcagataacaggaatattttaagcaaggggtaatatcttaatgtcttaagcaacagtgtgttgctcacttatatgtcatcactacttatcatgttatatgatgctttctaggttcatcacaaacatttgttaaataaataatttaatttagtaagcactgctacttataaggttgggtgctgggatgatatattagaaaacatactccttatcttcaaaaagttcatagaacggtaataggagaaagacttacattattacctatagcatgtgctagctaatgagagctgaataaagctctagatcaataaaaaatgttaagggaaagtaaagaaaaaagtgagtatttctacttgtgagtataagaaaaagtaaggccaactgaagaaaaaactgaaaaaagaagcctgatgtgggggcttatgcctgtaatcccaagactttgggaggctgaggcaggaggattggtggaggctaggagttcgagattggcttgagcaacacagtgagacacctgtctgcacaaaagaaaaaaaaaattagcggggtatagtgatgtgcacctgtagtcctagctatttggtaggctgaggcaggaggactgctggagcccaggaatttaaggcaacagtgagctatgattgcactactgctctctagcctgggcaacagagtgagccctgtctcaaaaaaggagaggagtggagcagagaggagagaagagaagaggaactattgcaaatttcaggtaacctggtaagaacagttacagatttggcaaatcttgtttgataggggtggaatttgctattttaaattgttttcatgatttctgggaatgcaatgaactactatagtttttaaactcatgaatacagcataaaaatcaacaagaacagaactcgtatctttcactataaagtgatctcattatcgaattgagttgtcttactttttgccacagaagccactaacaaacctgtgcatatttaaacgtgctccacaaataagagaatttcatgaagattgttttaaaaagcactgactgtaaccttacttcatttgcaaatgataaactctgcagtatctatggtttccttctataagcaagatctgttttgagaatgtaatcaaatatcttcattgcttagcaaccacaggtaaggagctaatatgtcatgagtcatgattctacgtgaacagtttgcaggtcagtggcatgatttcaatgccctttggattcttgctgtcatgctttcaaagccaatattaatacaaagtattagaatggatgagagttaagatgcaaatgctctcctaatcaatcaattgacatacacatagtgtgatctggtacagtctcctgcatcaagcttacactagcatctataaaccaacaccagcgtaaaaatagcccacagacatggtttcataaggaatttgtgttttaccaatttagttaaaccgaagatgaaggcacatttaaattagcgtgaaggtaacgactctgacactcacctaatcaacaggaaatcttctaagaaagaggaacagtgggtagtgaaacagttttggaaaactttacctgtaaccattgtgactggtcattgtggccagaggtccaggcattcactttgccttgcttgtccagccgagctttccttggttcccaagtgaacatgtccatgttgagcgttctgaagatgctggaggcagtgatctgatagtcttgtatatgtcctgatttcatacccagaggctcagaacaacctgaaagaaaatgagaagggctccatgagaaaaataattgatcacctggaacttttctgcattcattttggataggcaagagaagattaaacataatgctattcattcctccaaagagaaaacatctaaatccaaaaaaaagctataatcagaaataaatctgaaacaaaatcgaaaaacaagatagtcaattcaagctattttgtctgaatatattttggaaaaattgaaaacaagacagacaatttaaactacttttctgtgatagatgattctgcaaaatgaaaacaatgctgaaatgctctctcctgtctcattactggaggcctcctgactgctccccagttttcaacagtttcattgtgtctttaaaaatgggacattttctcacaaagtattgtttttcttttatttgttttcaaattactgcaaatgaaaattccctcagtacaaagtcattttcacaagctgctctactgctgtattctaaaccggacagcattttgtttttcaagaaatatgttaatcttcatcactgattcttatagcaccaacatggcttcttctgtaagagaggaatctagtatttactgagggtatgccatgtgccaggcattgtgcaagcataatttaaactaatagataacagaagataataagataattctagcaataaccaccactgaacaaaccttttaatacattattttatttcaatcatattcaataacctataaagtttagatatttttgtaagattctcaaatctaccacatgtatttttgagtttaatacggtaaaaattttggcttgcttgtccttgaaaaattatatgcatgcacatatgtttgtgtgtgtatacatagacacaaaatttcccagtcttggattgcaactgtgacaaaatgctctttacaatttttgtaatagaaagcatgattctatcatcatatgagcccggggctgagtcttctttatgtgaaactgttaaattttggtcaagtaactcacaaggtaagtttgatcatcaaagaaacaaagatgacaagaggacactcctccaacccaatactttctcctcacactctactgtctcccatttcccagctgtgtagccttgccctgttatttaacaactttctacctaaattttctcatctgtaagatggtgataataatagaaactacctcaaggaagtattctaagaaattacttaataaacataaagtacttagaaacagtgctggcacacagcattcagtcaatgttaactatttgtatgatttctgtaaaactcatcccaacagatggcaatggtaagtccccaaatatcagcatatcaacaagtactcaataatatttaattattgggtacagtttctaaaactagaccttttttggagtctaaactataaaagaggtgctttagaactcttcattgatcaataactcttagctataactaattgccttctgtcctggtctatctagattacttctaccttcttgaggctccccatatttcccttcacctccaccatctaggaaatgcatatcctatgaaaacatggaaaacatgacatggagggctgtgtgtcttaacacgagtacattttggtataggagataagtatctgaagcctcatattaaagatagctgtaatgcctacctgtatattctgggtgaaaaaaaagtcataacaattctctaagagtctagaaaattctaacaggcttaatggcaagctgtttatcttcaggaagttagtttcatagtggcatgcattgtctacattgaaaaattctgacttgttcttttatccccatctttgcctctacctgcatcccaccccccaagtctttgaaaactttgctcagtttgcaggagatacaagggaagaggaaagatagttgtttccctccttttgtgatataacatagtattgaagtactggatagaaaaggaatggctttactttgaccacttctgcttagccaaaaaattcactttatatccattctgttgtctagtatttatctcagaattgccaaattattggttcatagaatgaatgaatgagtattcctcctctaattagggtcataatctattttattccaaatatcttaagtcatacttctttcagtgtatttaggagatgatcttcaaaagtgtttgagaagagattacctgctcatcttctaggcagggtgaaagattttaatagcaatttactgaatacaataaggctttacagtgttccactggattgtggggagtagtttggtacattacattagtgtttatttccaggtgttacagctaacctctctgccaatgtgcctcatgccacaaattttacttcttatccatatgatttcaagcatataaattaattaactctcttaccagtgtggccagcacttgaacaaaatgaagtattaacaatgaaatgggtatttctataatgaagtgctctagttttttaaagcatccattgagagatattactctctgcatgcaagttcaaaatcaatttgctgtgctgggagatgcagcactgcttctttttgagaaaataaaacctgtaaagtgtcaggtgcaatgtcttgtcaaacttgggagtaaaatatattcacatcttaggggtgtaaccgtgccatgtgtgaaagactgactctcatgaatcaaaagactgaaaaattgtggaaggtgatgttaagcaactaaaaaccatgtggcttgcagcagatctcatcatattgtggcttcctcttgattgctttatgataaatggcttagggatgacactggtctgtggtgatatagtgagatgcaatacaaacactgtatagcaataagtctgctaagatttactggatcttaataactggagtaaacaaactggattaaattgccaaaataaggaaaatatctctgttaggaaaattaatggtactaaagcaaatgttggttgcttcaaaaaatacaccaacatagaatatgaaaatgtgattcttaaaataggctcacttgactgtacaaattactttaattcttaaaatgtattgggcttattaaaaattggctatttaatagtaaattttatttgcttgaaaatcaatccttttttaggcaacacaaataaatttaggaagagaaacagatataaagtatgcgctttaacctataggcaacctcttgaaatgaataaaaagctcacagttgtctctttgcagggacttgttctcctatttttaattaagtggtattgttttagatttggtaaaggtttttcctcacttcagggttacactaaaaagcggagcacacacgcacttttagttttcttcacagttatttgaacaaaataatttcaggccactgcagcaaagatagtttgtaaattgtgatgccagaaatgtaagaacaactaccaaaaatataacaagtgaaatgcctagatacaattttctatttcattcagaatctagctatattgaaatggggccactgtaagattcacacattaagtcctcatctttatagctaatattgatgttcctgggggacaagaattatttaactctgagtcctttgataggttatccttgagttggataaccactatttttacaataaacaggttgctagctaagaatgatccaagaatgaatttatattagcaatcttggtattgaagtattgaggaatgagaaattaaatgtttcataaaacctaaaaaaaagttcttatggtagacagacaaagataaagttcttatgatagatggacaaagataaagcttacttttctgtgttacatagcttaacctttactgcaatttatgaggtgggacagattccagtttttactaaactttttgtcggaaaacatagatcacagttattatgcaaaacaatgagacacatttaaaagtgacaattttcccgtgagaattccctgtgctttctttgaccactcaacaaaacacattactctttctacattaattctaccctgtagcatgttttagaacttgtttattctatacataaacacacactggttttccctgaaccatgttgtagacatttttccccagaaaaaaatttctatggttgttgaatttgtaggttagtaacaggctacatacaaatatgctttttgttttctttaaatagaatacagaaatagttaatttgagacttacccgacagttcacagccaagaagttccattcgcaaagtgcaatgtcttcgacaaacttggggatagagtcttacatactgagcttttatggggggtgtgaaagagttagcatatggagtgttgttatcaatgtttccacgaaacacctgtgtaaaaacagtttaaaattattcactgcaacagcttatttacctatttttacatatttaccctatctataccttatcgaaaataattgttcgaagaacagattacattatttgggagcatggagcatttgagaagtgccttgccatgagcactgaatataaaacccaaccataaactcctaattaaagccataaaccactgtggctcatgacatgatctatattccactgtgatggtcttgtcaattttaaggccagtctttcagaaccagggcagcgctcttctctttttttgagaaatggacaccttaaatccttcaatttaatctgggactgtctgctcattttcctacttagtattcatacttttgggggtagaatccagtctttgctactgcttccggatcatccagtctctctaatgctatgattagatttatgatgctttaaggtttgactcatgaagattatgtcttcatcaaccagtcccatgtacttggataatagaattccttattaaaatttccagctaaaaactatgtttgcctctaaaattcaagtactataatgtgtcattgtaaattcattaaggcttattcttattttaccttttatgtaaacctgataatccaaaaaccttatttaaattcatttaagggggtaattttaaaaatattttatataatttattagagtctggtataatgcctgattaaatggaatgatctccagtcctgatatttttaaaattaaaattttcgatgaagaactaacaaaagaattgagaatatcataagaaaagaaaaggaagtattgaatataatattcaatacctctaaaatattttattttgctaagtaacaaatctttcttccaatatgaagcatataaagatatatatctcttctatcacttagtgcttttttgcttttaagaaaatagttttcattaatataatagttatctcattaaggagtgcgttaatcagccgggcgcggtggctcacgcctgtaatcccagcactttgggaggctgagaccggtggataaggaggtcaggagatcgagatcatcctggctaacacggtgaaaccccatctctactaaaaatacaaaaaattagccgggcgtggtggtgggcacctgtagtcccagctactcagaaggctgaggcaggagaatggggtgaacctgggaggcagagtttatagtgagccgagatcgcgccactgcactccagcctgggcaacagagtgagactttgtctcaaaaaaaaaaaaaaaaaaagtgcgttaatcacgaaagcaataaaaatgtatcattaaaataaagcttaattgtcatacaaaagactgtgtccacctgtgtcaaagtatttgtagcaccaccaattaaaatctgtgaaaatcttaaatgtcagccattttaagtttataaactggagaattactacttccttcatcacactagcccaattaaaaacaagacgcattggtaatttattttcatcaacataagtcttctcctgaagaccttgtcatttgataatcaataattatcaatgacatttttcttttaaattaagtaggttaaattattcttaccatgtcttcattggtgcctttcactttgtacattgcccaagtctttccatcattactgtaggcaattttgtaggattttatatactctgggcttccaatcctcttggctccttgggtaatcacaccagtaactctcattttcctttgcaaatttatctgaaaagacgagcacaaccaacaataatcttattgttttcaggataacaatactgaaaatacgaattttagaaatgaaacattgttaatgcagattaataataacataaaaagctaataattttcatggataaatgtttacaataggcatatattaaatttagcttcaaaatccctttctgtaatggaatactatttttaagtaaacaaatatttgtgaacaggctttgaaaagggcaatgtgccccaaaaacataagtatagaaagcatctgcgttctcacgatatgcagatgtaacttaataaactgaaaacttggaatattctcttgtcaaaataatctcagtgtcattactataaaactctattgtcaacataactattaatgtgtataaactgatttaagcttctagaaatttccatttacaataaaacatgacaatttcactgagatctttgaataccagaattttaaaaagtaaagacaaaaatgatgtccaaaccaaaaacaaacaagtatcccttaagtttctggatctttacactgtagtctgtggagcattttttaaaaaaattaaatgattgcttttttcttcattttattataagtaaaatttctaactggaattttctgtctccatattttctccccattccaaatccctttacaacagtttgcttcaggagtaacatacatcaaataaaattgttaatattcttctcatgtttaatagagatatctttttgacacttaacacttaataactaaatcaaatgctacaatgtagaaaagtgccttattcatatatagtaaacattaaaatttcacatattgtaaacattaaaattaaaatgcctttatgatgtctataaaatcttttaaatgttcttgataaattgctataaatcaccctctccaaaaatataaattggaaaaatttaaatatgtcataccataatattaagttaatgattcagatattattttccaaagaaaatcagaaaatcttcagattcatgtaagtgattagagttttccactgtaggaggagactttgagagttagcatttgaaatggtccacggtgtgcatgatgaaaactgccaccctatcgccattgtttctgagtctcccaaagtctcatcttccccgttgaaacctcataaaatccttccctcaactatttcccacaaggtgattctcagtcttgttcatatataaagaaaatctggagttttgatgagtacaattttttgtgttaaaattctgggccgatggtcccttttttccttgaacaatgctaagtggatggactcagatatccaagttaggttttctcattttgatgttcagacatcacacaacaactataaccatgagtacattttaagtcccattcctctttggaggttcaaaaagacaatatccctcatgaatgtaaattttacttactactcttaatatttatctacatttatctccattagtcctttaaagattgattttggagttttaactatgcaacttgaaagagggaatgtttgaaagatgtttacttcagtatgttaggtcaattagcacatcgctatgaaagagtcatattctttcattatcttatgcatgacattttctttttttttaatctgagactctttgtagtttaaacatttccaatacatacaatatgcacagtggacactttgaatcatgttttctcccattttggaagccaagtttcacatctgatgttgctgaacattcctttttcaattatcttttatctcatttcaattatcttgtttatacctgttgtagacagccaaattatctttgctagagttttggctcataagctatagacactaattttctaaagctttaattgtagatgcataatagtttgtatttttctctaaatcattaaaaatcatgtaaaaattctctttgctctaatatttagaagctctgcatatatattttaggaagatggaactgcagttagttaagcatcacccagtttgggttgtgtctaacttttagtagatatttgtaattaaattttggcactgtttccattaaacacaaaattaaaatgaaaaaatttataaaaatacaggctcaggctcactaagttttagtaattacaggttttaaacttttgacttttcatgtatctagcactattaagcttggaaaataattcaatataaggaagctaagctgtcaccatcatagtcatactcaaatttaataccagtaaactatgttgctataggaaataaactaagtaagccttggaggaaatatatagtatgattttggaaacacctccacttacaagtatctgcaagtaattcctttccatcccattccaacattattttgtgatatctctgtaaaataacaatggctaaaaggtgatcttaattttattctccctgtatgaactatcccacatactatgtaaaaggtctattgaggattgcatcagaaatgcctaaattattctctatgagcttggtggatgcctgaaaaggaaataaaatattttcatttatgtatctgatttcagagaaattgttgttccactgggtggtaggaacactgtgtatccttaaaaagcagaagtgcattctaaggtattttgaacaaatggtagcctcctacattaatataaatagaatgataatctgaatctagaatgcttagaacatatgctaagggtatgcagaagggaggaatggactaatgggggtttcagtcttggttttgtcacttccgacctatataatcttgaacaatttgtctaagctttttgaaatttaatttcctccctgtaaaggaggttttaataaaatatgtgaatattatatgatatgtgcatgtaaaacattaacaacatctgccacctagaaagcacttagaacatgttttttattttaagtttttggtttttttttacatgaaaaagagcaaaaaagcattttctttacatcttctgcctttaaccactcaatgccagaaaatttggattttgagaagtgtattataaaagccgataatcataacgatatggggtggcgacagggaagtgctgggaggagaagggcagggaccctggcgagcgttccaccctcgggcctgtgcccacggatctaggtgaggacaaacactagtgttttcatgcccaaatgttgcattttccaagagcacctgtcccgccacaccccatcctgtgcctgtaaaagcccccagaccctagtgggcacacacacaagcagctgggcactgagaggaacagaccagcagaagagcacacaggtggctggatgtggagaggagcagaggagcagaagagcaccaccgacaggcaccggtagacgccagcaggccatcgacccatggaatgatgtggataccaaggggaatttggccaggacagttggaggagagtcctgccgctgagcagcccaactccagaggaagaccaccttcccactccataccctcctggctccccatccacctcactgagagctgcttccaccactcaacaaaaccttgcactcattctccaagccaacatgtgatctgatttttccggtacaccaaggcaagaaccccgggatagagaaagccctctgtccttgtgacaaggtagaaggtctaattgagctgattaacataagctgcctacagatggcaaaactaaaagagcacactgtaacatgcccggtggggcttcaggaactgtaaacgtttacccctagaagctgctgtggggtcagagcccacgctcccaatgacctgcccatctgtctcctccccctaagggttttgcacagtgagacactgaagaagggagccacatcccatcacacaccttgcaagggggacaagggaacttttcccgtttcaataacaagcatataaagataattttgcaaacaactttcaaagctatatactaataagacatttagggctactatggttaagagtgtgtgtgtgtgtgtgtgtgtgtgtgtgtgtgtgtgtgtgtttaaatctaatcatgagtcttaccatggggggtgggattaatgggttcttgacaagacagcaactagcatgggctactggtcctctctactgaatccagcacttaagatgccctggaacagaacattgctgagcaggctttgaaatttatcgtacttgaacacaaaaactatggtaaagccttagtgtaagtggaaatttgagatcccagtgtatgtttgtgtagctggggtttattgagggtaactccaagggctcataaaggttatcaggcttgggaagaactttctaaatgttctatttctctttctcattctcattttgcttattgagctctttctgatctacccagttccagcccactgccagtgagaagcagtggaaaaatgtgggccaggcttagacaggagtctgcaggcactagcaggcctgagtgttgtaccctctgccctccacatcacaggttatggactaaggaggtaaatcagagtgatgaggtcctggtaagagcagtgtctaaggcagatgaagtattttgtgggaaaggggactgtagagtcagtacagattataattctgctataaggtatcctctctacatcaactcaatccatttgtagtagctgaagctgggacatgaattttacccttccttctagatacatcactagctaaggtattaataacaaattctctagggaatgtaagcaccatgatcaaaaggaaaaaacagaactaatactagaataaaatgtagtctaatggagaacagattcagactttaaaattcaaaagaaatccctgaaaagacgaagattttctgaaacataagacaggaacaagcatataaataagaaccaattggtgatactggataattggacataaaaagataattgtctaaataaaattcccaatggagtggtttcaatagcaaagaagcaaagagacacagctgaagaatataaactagtaagcagcaagacagtgttataaaaccctttccagaagggaagaggatggattgctgagatttctcatattgggagatgatgcaactaacaatttactttgaaaattctagagacgcaagaaatagtaaaaactaatttaaaagttctgcaagtttgcttaatagaagatcaacatataactattctacaccagcaattatcgactgaaaatataatcaaaatagtgtgataccggcacacatggagacagatgaatagaacagaatagaaaaccaatagactccaatatgcaggaaacttttgtatatgaaataaataatatttaaatgagaggaaaaaagacagagtattaaataattgggacaatttgatagatttctcaaataaatttagatcattgcctatcatcctatcccaaaataagttccacaaaattatcagaggaaaacacagaattaaaaacaatctcagagataaaaaaatgggtttctattcatgacactagatttaaaaatgttattaattaaagtaaaaatttctgcaagattaaaagcaaaataaatacaaatgacaaatggggattaaacttttacaaattatatcatagcaaatggttgatcaatcaaagatattagattatacatattgatagataaaacacaactaacccaatagaaatgagcaaaggatttgattagtagccattaaaaggaatgaatatggattttaaacatatgaaaagataatcatattcataaaaaagtaaattaaatctacaccaagtaatcataattcacctatcaaaaacaaaaataaaaatgttggactacacaatattagcaagaatatggagaactaggcatgtttatatctatgagactataaatgacatagttttcatgtgatagtgtaatgacatcatatttatgaaagacaatttggttatatgtaacaatgacaaacacacatcctctttaactcagcaattctatttaaaaaatgtatcctacaagtatgagtaaactgatgttggcaaaaagttattccctacagcactgtatataataaaacacaaattcaaacaatttaaagtatctataaataggcatctaagtaattttattatgaaaaagtacagaaaagaagatactatttacttgtaaaacataagaacaagaatgaaggaggaagggagggagtaacagagggggtgagaaaagaatggagggatggtggagggagagagagagatcttagcataatgctgtggaaagagtagtaagacttcagcaacaggacagtgtattgcatactccccaaaattttaaaaagtaaacacttttattacaagaacaccacaggtaaagttcacaggaaggtgacaatctgggagaagatatctgcatgtctagatttgacaggggctgcttcttcttcttcttcttaaaaagtaaacagaaccaaagacaaaaaccacatgattatctcaatagatgcagaaaaggcctttgacaaaattcaacaactcttcatgctaaaaactctcaataaattaggtattgatgggacgtatctcaaaataataagggctatctatgacaaacccacagccaatatcatactgaatgggcaaaaactggaagcattccctttgaaaacaggcacaagacaaggatgccctctctcaccactcctattcaacatagtgttggaagttctggccagggcaattaggaaggagaaggaaataaagtgtattcaattaggaaaagaggaagtcaaattgtccctgtttgcagatgacatgattgtatacctagaaaaccccattgtctcagcccaaaatctccttaagctgataagcaacttcggcaaagtctcaggatacaaaatcaatgtacaaacatcacaagcattcttaaacaccaacaacagacaaaaagagagccaaatgatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgtcatccccatcaagctaccaatgactttcctcacagaattggaaaaaactactttaaagttcatatggaaccaaaaaagagcctgcattgccaagtcaatcctaagccaaaagaacaaagctggaggcatcacgctacctgacttcaaactatactacaaggctacagtaaccaaaacagcatggtactggtaccaaaacagagatctagatcaatggaacagaacagagccctcagaaataatgccgcatatctacaactatctgatctttgacaaacctgagaaaaacaaacaatggggaaaggattccctatttaataaatggtgctgggaaaactggctagccatatgtagaaagcggaaactggatcccttccttacaccttatacaaaaattaattcaagacggattaaagacttaaatgttagacctaaaaccataaacacccgagaagaaaacctaggcattaccattcaggacataggcatgggcaaggacttcatgtctaaaacaccaaaagcaatggcaacaaaagccaaaattgacaaatgggatctaataaaactaaagagcttctgcacagcaaaagaaactaccatcagagtgaacattcaacccacaaaatgggagaaaattttctcaacctactcatctgacaaagggctaatatccagaatctacaatgaactcaaacaaatttacaagaaaaaaacaaataaccccatcaaaaagtgggcaaaggacatgaacagacacttctcaaaagaagacatttatgcagccaaaagacacatgaaaaaatgctcaccatcactggccatcagcgaaatgcaaatcaaaaccacaatgagataccatctcacaccagttagaatggcaatcattcaaaagtcaggaaacaacaggtgctggagaggatgtggagaaataggaacacttttacactgttggtgggacggtaaactagttcaaccattgtggaagtcagtgtggcgattcctcagggatctagaactagaaataccatttgacccagccatcccattactgggtatatgcccaaaggactataaatcatgctgctataaagacacatgcacacgtatgtttattgcggcactattcacaatagcaaagacttggaaccaacccgaatgtccaacaatgatagactggattaagaaaatgtggcacatatataccatggaatactatgcagccataaaaaatgatgagctcatgttctttgtagggacatggatgaaattggaaattatcattctcagcaaactatcgcaaggacaaaagaccaaacaccgcatgttctcactcataggtgggaattgaacaataagaacacatggacacaggaatgggagcatcacactctgggtactgttgtggggtggggggagtggggagggatagcattaggagatatacctaatgctaaatgacgagttaatgggtgcagcacaccagcatggcacatgtatacatatgtaactaacctgcacattgtgcacatgtaccctaaaacttaaagtataataaaaataaaaataaaaaagtaaacatttttattacaagaacatcacaggtaaagttcacaggaaggtgataatctgggggaagatatttgcaacatccaaatttgacaggggcttcttcttcttcttcttcttcttattattttgagacggagtcttcctctgtcacccaggcaggagtgcaatggtgcaatctcagctcactgcaaactccgcctcccaggttcaagcaattctcctgccttagcctctcgaatagctgggattccaggcgtgtgccaccactcctggctaattttgtatttttagtagagatggagtttctccatgttggtcaggcttatctcaaactctcaacctcaggtgatctgcccgtctcggcctcccagagtgctgggattacaggtgtgagccactgtgcccggcccacaggggcttattactaagtacactagttctcaaccatatggtctcggtacttttttaaaccttgtacaaattatcaaaagccccaaagtacaaacacgtgcaaaagtgtgcacgcacacacacacacacacacacacacacagacacacactcacgtgccattgtgggttttatatatatatatatatatataaatatttatcatattagaaattaatactgacaaattaaaaatatattaattcacctaaaaatgacaataatgaacaggttaaatattaccattaacactacatttttatgaaaataattatattgttcaaaaacaaacaaaaatttactaagaaagagttattttatattttatcaaatctctttcaaatctagcttaagagaagacaggttctcatatttgtttctatattcaatctattgcaatatgttgttttggttgcaatataggaagaaaatgtagcttcatacaaatatgcagctagaaaagaagagatgacttagcaacttttccagataactgtagatattctttgataccataccaaaacttgaaaagtttgctttttaaattttaacaaaagtagtttgttaaattttagatgctttgtggaatctgaaatctaccaatgaagattttgtattccttgtgttaaaatccattggtctattttgcactttgaatggatttttcacccatgcatggttttgtaacattatacattggtcatttgcaacatactggctcaccgagctacgtagattttctaagcgatgacacatttcactatataatacaaaaacttgcactgattaatatcaccaccaatttcatcagaaaagtttttaattattggaatgtatgaaactcacattgatagttacaagttttccaaaattataaatttcacttgaaatttccaattttataactagcaacaaagactgtcagctgttttcattgatgtggcaggattgctgtattcattttcaagacaatatctgcctgatacccaggtatgaataactatagttggtctgtcagttgttctttgaagtaaacatgatacaaaaaagtaggggaaaggagttgtttaccttgaaactcacacaatcttgcaaaggcttttcctgtagacaatggtcacatttcagtactcagcaaaagtgctttatgcataaaccccttttcatcacacagaatactatagacttaaaaaggattgacatttaataaaataatagaattagttatcattactgcttcatcaaggatgttcttaaatgaattggatactctctttttttactcataagtgtgtaaaatagagataaatacaatgatgactagtatagtttgatgctatcgtcatgatttgtgccaaggcactagcagttttactcaccactgtttgtggcatcagtacaaacgttaacagagtaaaagtggcaaatatcgtcttagaaatattatgaaaattgtgttgatttgtgaatctcctgaatgagtctttgggatcccctgcttcttcaagggatatgtgaactgcattttcaggtgagaataactgatctaaaatatacaagggtgtatgagtccattttcatactgctatgaagaaatacctgagactgactaattataaagaaaaagaggtttaatggactcacagttccacatggctggggagggctcacatggcagaaggcgaaggaggggcaaagtcccatcttacatagtagcaggcaagagaatgtatgcagggatctgccctttataaaaccatcagatctcatgaaagttatccactatcatgagaacagcatgagaacagcatgggaaaacctgtccccatgattcaattacctcccaccgggaccctcccctgacacatggggattatgggagctacaattcaagatgagatttgggtggggatctagccaaatcatatctagccaaatcatatcaaatcatatcttctcccttctttcttcctcttcccctcctcctcctctttcttttctcttccacttcttcttttcttctttctttttcttcctcttttttttttgcaaatcacatagacacacacacaatgcaaagagatgaggaaatcaatagaaaatggagcaaatgatattaaaggtaactcagagaaaatcttcactattaaagaaatgcaattttgttaaaaaaagatacaacaatttacagccaacagaatggcaaaacaaaaatatcaaataatatcaagtattggtgaagtattctgatgctgatgatgggaatgtaaactagcatagccatttctatctgttagttgttagtaaaattaagcaaccctatttctgggtatttttccctgaaaaacttttgcataagtgctcaagaagaaatccacacacatatctattgtaataacttttatgttagcaaaggagagcagcttaggtgactatccccagaggaatcgaatattaaaatataaagtgtacctgtgtgtatgtgtgtgtgtgtgagctctcacacaataaatatactctctaagaatcagaaatgatgaactgggtttttatacggatatctaaaaaacataagaatatgtgaaaaagaaacaagataattaaatacacacagtaccatgtatgtaaatttaaaaacacaccttatgatataacatcatgtactctccaataattgacttcaaatcaacacaaagaaggtagaatgaaaggttacacatcagctactaggttgggctcacatagaggaagaggaataggaaggaaggtgggaagagaataacaatttaatattaaatggcaagataccttacccagactgatgataataatgtgccttgaaatagggaggtgaagtcttacatcagtgctggcaggtgagatctgaagtgggggaaaaatcattggtttctcctttacttctctattctcaaggaaaatgacttaagtatggccatattatgcaatagcacagttacctacaaaagtgataggaatgttgaatacagaggtcctaaatccattggaattttttgggtgatagaaacctcttttgttctaatgtggtgactcttgataggctcctgaatagccttgggatgagagtggtggccaagggaaccaatcaggtgattggagggttggaacttcagccccacccctgccccgtcctctaggaagaggagagggactgaaggttgagttcaccattactggccaatgatttcatcaatcaggcctaaataatgaaacttctataaaacctccaaagaacaggtttcagacagctttcgggttgctgaatacacagaggatcctgtagggtgtcacatcagagagggcaaggaagttcctcttctcttctcccatatctcaccctatgcttctcatctgcttgttcatctgtatcctttgtaatatcctttataataaacaagtaaatgtgtttccctgagttctgtgaggcatcctagcaaattatttgaacccagtgagggtgtagtgggaaccccaattcagatgcaattagcgtctgaagtctcgtggaactgtcttgaggaagtcttgtgggactgggcctttaacctatggcgtgtgcagtaactggggttagtgtaagagtgtgcagtaactgtagaatactcagtcagtgtccactgaataactggttgttggtggggagaatcaccgttttgtgaccagaagtaaagtgttaagtgaaagagtaggaaatttttttttttctatctcaaacaagtatgttttcaactggtcacagtgaaaacaattctcctactagggcttttgcttgggagctggcaatacaaatgtgtctcaggcaaaaagaacaggtaaccatctgttttgggtgataccagaaataacttgagcttcccagacagttctaaatagacttccaatgatttggattgcaaatatgtcacttaagggatttaaaaaaataaacagacaagcatgatcacctaaagtttccagttaaaaagcacagttaaaaaagttacagggatttgcaactcccctgttctttcacattatcttattaatataaagtattttatcaaatgcatcattaacacattctgtgaaggcttgggtggtgagaagcatcatgaacacacctaaggaggaaggctttggaggtgtttaaggataaaaagagtaactctggttcacgcctgtaatcccagcactttgggaggccgaggcgggcggatcatgaggtcaggagatcgagaacatcctggctaacacggtgaaaccccgtctctactaaaaatacaaaaaaaaaaaaaaaaaaaaaaaaaaaaaaaatagcccggcgtggtggcgggcgcctgtagtcccagctactcggtgggctgaggcaggagaatggcgtgaacctgggaggcggagcttgaagtgagccgagatcgcgctgccactacactccagcctgggtgacagagcgagactctgtctcaaaaaaaaaaaaaaaaaattaactcaaatataactagtcctagtggctacagtagagtctctcttaaaccacctccaaatcagcaacaacctgagcactgacactcttcactgccgctgtgaaacataattgctgctctacacatctggcactttgggctgttctctgctaagccaactctcttctgttcttgcagattaattgcacgctcatcaagggtcatttgtgtttgttccccaatctgttttcttttcaagttgtgattgttattctacttatgtaatctaattaaacacaattgataaaatgtgactggaaaagaaaaggtttttttctataaaaacatgaaaaagctttctgaaaaacctcaaaaaggcatagtactaaagagtctataatattgggataattaattgatatctaggattctatacttgaataacttcaccaatatgtttaaacaatgaaataaaaagaagtatcaattataaatttcttgacgtagtttatctaagaaacatagtatggaatttaaatgcttttttattttaatcaaggtttttagtaactaaccaaacactagttctgatgctccagataaaaggacctttaaactatcctccatgttctgaatgctggttagcctttgacatgtgttcaattaacttaattgtcctctttgaataaccatgggaaaagaacacatatgcataaacataaaactataatctctttatgattctctgcacctggtaaaacttccaattaaagtgaaacaccccattcattacacagcatgtaacaggagcaatacaccaccaggggtgaaagctgttggcatttccaggagtcggggccaggtataaccatttcatctgaatttccacctgtttctgaagggcttccactatattgtactcatctctcctctcttggtaccagctgttagagtttcttcacatcctccatcacccacagctacacattcaggagtgaactgaactggggctacatggttttgaaaactacagcttgtatatcaagtttgatgaaattgtaaatattaaggtagtctcgaactcttgtaaataaagataaagttgaagaagaaacaagaggaataaaaagagcaaacgatgtcagcacatgagtagaaatgctaatcccaataaaaaccacattagaaacaatgaaattaaggtcactttgctaatgaatatttttgaaagaagccagagtgttaccaaaaagaaaaaaaaaagtctttaatgcacaatctcaggggcagtaagtgtgctatgaaggggagagggaagaggaatgctgtgtgcgaggcttgactttcttacatttctataggtggctcatgccaataagcattggctctttagttgttgtgaaatgggctgtacaaaagcaaacagcaaaataatcaccacaaacctgttcaaccaaaagaaaaaaaaacagaaaaataattgctgttgaaacattttaaggagtttattagttaaaaactttttaacagagagatggggaggtgcattacttctaagagctgacccaggcatgatggacaagaatctcaccacagggtccatatgaatgctctccttggcatttgccatcacactgagtggatttcaaactgagtacagtgctgagtgaataagaaagaaaaataaaaatggaatatccaattactttaagtatgtcctaaccgaaaacagaattctctgataatcatatctccatccagcatggcaaaaggttagcaggcagatgagaatggattgccagttatggcccctgatttttcttaatccagtatattatttgcagcatgcaaataacaacaatgccaacagaacagtttccaagttttgctatgataatactctacacctttccatgtgtggaaatattattggtagtggtagcaagtgtcctggtattttaaattctgacttgggatcaattaaacatcaagacaaaaacaaatatcacaaataaaaagttaaaaggtacttctgggaaacagaaaactgtgatgttctttatttttatgcactgatgataaaagaagtctacaaagcaaacatacactctagtgtaaagggcgacatgttttctagcatattaatttctagcatggtagaatgtgaatgaattaaccaaaaaaagaaatgagagagctaaacagaaggagtggctgcctttggaacacatacacaatagatattatcaagggacaacttagcattctacattctttgtgtttttctggcattactgtaatccaaatatatacaatcttaaatttgcatttcaaaaataaaataaaataaatacattttaggaattaaatctcattgtcacattgaaatacattaacatatgttctgagaaataacaaaagggcttttatattatggtttttcttgagaatttaagtttatgattcaaaaaatgtgtatcaataaactaaatattccttagttgtttctcttattgagttgttactatagacctaaaggtagctgctaggaatgttttatgctgaattaaccagattattgaatattagacatattaggagtaagtttttaatatgttgtccaaaatcagacctacactgtcaatattccgtaatctcttaacacgtcccctgatacaaaagattcattgcagtctgtaatgacgtttacctggaagaggtcatatcttttaatccttccagctgcttatacatttctatagcagggatgaatttttaatttgcattgtattttcatgggcatgtgggtactacgtttaaatatttaattattttaaaaataaaataggaaagataaaatagcttaaagtgtattgatgctctgaataactttatgagtgaatagatactgaaatttgaagtcagtgttttgcacaacaaatcaagatttgggactggacttactgggttggggacttcttagggataacggtggtgctatgagcatgctggaaagatgagaagcaaaagcctggaattgggagtcctgtactgtctttagggtatgcaaagaggctccttctttctaggtgttcatcagtacaatatgaccactgaagggcaaaatttcctgtcttgaccccaggatgttaaaagaaagaacaataaaagttttgtttcttctaagcaaagttttgtgatctaacagttgatgactctagccaagagcaagatgtttgtcttctgaaaaccaggcttgtaacccacccatgctagggtactagctaacataaccttgggcatttttttttttaactttttaagccaaaattttttcatctatacaatggtagtaaaatgctatccaactcacagggttatctgagtcttaaagttgtccgttaggtaccctgcatctttaagcctttggttgtttgttatcattaccattcttctcagaaaagagggaaattaagtttatcatttacaaatatagaagaaagatgagtaacaaagaactaaatgatttttcaattcacactgatcaagtccttttgactttttaaaattaacttcattcgaaatacttttatatacatgatagagtatttcatttgttctttatattaaccctaaaaaataaattggatgattctggtcttcagtatggtacaagtaggggaagaagatgtggaattgtggtcatctctgcttccttggaagtaaagagcagaatacacagagaaaaaccaaactcacaacttcttaataaggtaggaatatactttatatgttttcaaaaaataaagtttcaaacactcctatatagcaagaaataaattatttgaaatttaggagggaaaatatagagtatatctcatcagttaaaaatagtaattttgccaaacagatgttggcagttaggaaatcttttaaaaactcacatattctatgttttataaagttttatttctacttcctctaaatagcataatataatctgatctaacgttttctaacgttgaagaataaattattataaattgagagaacatcattcttttattttttgatttcattactctgacctaaatttagaaaacaaattatttttaatgatcaaaagctacctcattctcatcactgactagattcattcataaaagaattgcatctgtaacacaagttttacagttaattttatgaagagtgaatagaacaatatatatgtttctggcattcacaaattccctcaaggtcattacaacttatttttccagctgtatctctgattattattacacgtgcattttgcttttaaataacaactaaaagtatttaattcatcaattttttttgcctgtctacagagtccaaacactatgctagatgcatggaaatctataaagacaggagagatctttgcacttgtcacatgtattctagaaaagaaaagacgcataaacaacaaattgaaacacaagaacattataaatgatagaggaacaaatgctttgccaaagtgaaaaatgtatgtgttttattttggtaagaggtggaaaccactgaagttttgaaaacagacaataatctaagaatggagaaaatctacagttcaattttttaaaaaatctacagttcaattaaaaaaattcaccttgcattgtaatttaccttgaattattttgaatgtcctaataacataatcagggtattttgttagcagaaattttacataattttaaaaatcatatgagtcttaggatttgggatttataatttgtaactgtaaatgtgtgaaacatacaaacatgtgggttagaacatgctcctttagctaagaggagtttgttattacctaccttctgaagccttcttctgtcaattcgtcaatctcattctctgtccagttttgcacccttgctggagagttgttgtgatcatttagaggagaagaggcattctggcttttgaaattttcagcatttttgcgctgatttttccttatcttcatggagttatctacctttgatctttgaggctgatgacctttggctggagtttttgtgtgggggtcttttttgttgatgttgttgttgttgttttctgtttgttagtttctcttctgccaagcccttcttctgcaggtcagctgcagtttgctggaggtccactcccagaccctgttcacctgggtatcatcactggaggctgcagaacagcaaagactgctgcctgcttcttcctctggaagctttgtcccagaggggcaccaacctgacgccagccagagctctcctgtatgatgtgtctgtcgacccctgttgggaggtctctcccagtcagaaggcacgggggtcaggacccacttgaggaggcagtctgtcccttagcagagttggtgcgctgtgctgggagaatcccccttgtcaggatcagctgctctcttcagagccagcaggcaggaaagattaagtccactgaagctgtgcctgcagctgcccctccctccatgtgctctgtcccagggagatgaaggttttatctgtaagtccctgactggggctgctgcatttccttcagagatgccctgcccagtgaggaggaatctagaaaaacagtctggccacagctgctttgccgcgcctctttggcactgtcacgggaaaaccacctactaaagcctcagtaatggcggatactcatcccttcaccaagctcatcaacccaggtggacttcattcaggctgctgtgctggcagtgagaatttcaagccagtggttctcagcttgttgggctccatgggagtgggacctgctgagtgagaccacttggctctctggcttcagccccctttccagaggagtggccggttcttctgtctcactgggattcaggcaccgctagggtacaaaaaaggacctcctgcagctagctcagtgtctgcccaaacagccgctcagttgtgtgcttgacacccagggctctggtggtgtaggctcatgagggaatctcctgatctgcggattgcaaaaatccgtgggaaaagcgtagtacccaggatgggtagcacagtccttcacggcttcccttgttttgggggagggcaggtcccccggctccttgcgctttctgggagaagcgacgtcccaccctgcttctgctcgctctctgtgggttgcacccactgcctaaccaatccagtgagatgaactgggtaccttagttggaaatgcagaaatcaactaccttctgtgttggtctcgctgggagctgcagaccagagctgtttctattcggccatcttggcccctccaaaaagggcttccttttttacacttaagaaattgttaagggactagcactatcatattctgccttgaatctagtcgtgaacatggtattttgctgactcatattaggtatgagacagttcagttgtgagtgacagaaaacccaaactaactatgtcttaaatagaaagaggcttcttatttgggtaaatgtgtgactacgcagaaggtgctgataaatcagggccccaggtatcctctgtctcgttacccagtgtatatacctgatcccacggtccaagatggcagcctctgagttcctggaaggatggaggcagggatgaagaggggagaagaggatgtgtggatactctctgttaaaaaaaaattcctaggaaccaccatgtgacacttttgcttatatgcctttgaccatttgagagtctcatcaacaatagttggccacatctattgttgggaatgagaggttgggaaatatatttagctaataatctctttaatatgaaaacagatggaaaggatgttgggtaacagttaaaagtcctgactataactcttaataaatatttgttgaattattgagaacatgcatttattaatcactggctttatggccaatacatgactaaacatcctttgtataatcttcacaacaattttaagaggccatctatttttgttgactctttgtatataaagaagacatacctttgagtggcccagtaactttgttcaaggtgacagtcaatggccagtagaacccaggatcactgatcttgaacatcctcttccttcaccatataatataactgcttatgtaaatgtgcttcacttgcattacatttaaacatccagagaacaggtaatgtggtttatcctcactttatttattaatgcattcaaatatatttactgagcaaataaaaaatattctcagtcttggggatatgaaaacattatgatagcatatctgtttcatttttttatgaaaggttagtcactagtcaccagtcactgagattgacgagaatacaaagagagccaacaaatagtattcctgccctcatgcagcttacctaataaacaatatcttacatagtctaattactagctgcggcaagggctgtgctagaaaagaacaagaagctgtgaaaatatatattagaatggaatctagttgaggagagggatagggttagggaaagcttccctgaggaactggcatctatacagcaattggcacatgggaaataataaatatattgaatgaatgaataaattcattaatttaaatgaagttgggggtctcttgggaatatgttttttctaagcatggaaaaaaagaatgaagtacccttcaagaagtcccatgtggctggaactcacagagtaaattcctcacatttcccagaacataattgcttgttgaatgaaatcaaatagctttttctctctgaaatgtccacagaatgaagtagaaaacttccatataagataatttgaaatgttttctccactccaataagcccacatgggcagagaaaacttatatattgtccaaatagctctctacaaatagtagctgctcaacaaatattcattcatctactgtagatttgagactcagaaaaacattccaaaaagtatcagataatgcattgatgtttcaaaatttatgtacatctttccaaatccaggctaatgcatgctcttaaaaaaaagaagctaagatacattggcaattctatttaaatgtctgggttttttgtttgttgtttgttttgttttgttctgtgagaatcacattttggtttaagagcttctggaaagctgacattatgtaaaaatactggcttaggctgggcccctgcaaagaaaagtaagataaaaatattcacatatacttctaaaattcagtacttcatctcttaacaacactaatgatagtaataaactaaggagacctgcattgaacatagtttttctttttttaatctgagaaatgaaaatacagcccatgtattatgaattcagagaaataaatgtttcaaagtgattgaagcattaagtatataatagaagcaagaaaatgtgacaggctatttgtggggggaaaaaggagagcttgattattttcttcaagagccaaaatcataacaaaataaagtgatctataccaagtacactagcattaggatgaaatagctaccactttaattaaatatatcagttttgggaaaacagcagcagtggtagcaaaaacatcaaaagcaaatacatggagaaaatgtaaccaacatatgatataaaaaagaaatgttctgaaaaaggcattaaaggagaataaatacactcatttagaacctcaaagttcagtgtatctcttctctagagtcctgcaaaatgatactttcaggtgagctatagtctcagaaactgttttgatgaaaatggaaataggagaagatgaaacttcatttagaagttcccaaatgttccctaactatctctttcaactctaagtggatgtcactcaacctcccactccactagatggggccatgggactcataaatggccaacggcttagaagcagaagtgtcacatggcagtggtgtccatttaatccacttccactctctatccagagcaacaagtaattttccaactcaatgctatacacccttatcaggatttttctccaagttaatcaaaaagccgatgaactccttttcttgaatttgatagatatcttagtagttaatgatgcatcctcaagctctcttagtatttcatcttttatttttatttcaacagctgccagtctagtttaggccctccttatatctgcctccaggcagttagctgtaaaagcctcctagctggtatccttgctcataggttcccctctctctaaagcacaattcaacaattattccattaaattttactgaaagcttcatcagcactaggcattgtgttaggtattcagaacacggaccacttacatgtcatcttcctaaactctagttctgacagtatcaatacccttccataatcaagtgccaccttagtctaaatgtgatgtattttcacattttggcatctccttaccttttcaatcttttatcctcctattacccctacagatatgcaactcttcactataataagactttactctgatgtccgttgagctttctccatccccagtgcgactttgtttattctattctctctgtctggaataacttccttaatgtcatcctcaaagatgctaaatatgctaaaccatctttaataattaaaatgtaaatggattttcgatgttttcattatattccagttgcacagaaaacaagtatttcttaagaactcctaggacccagttaaaaatttaacagtaaaacatttaaagcctggtcttatgaggttgtgaatattttcacaacccttttactatttagtcataacttaattattgaaggcctcatgttgtaggcaaaaatccaatcccttggaaacaattaagcattattaccatttttagttcatggaggaatgtggattccacctaaggatgtcactagtagaggcaggttaataataaaataccatcaaggcagcatagattgttatgttttggatttgtaatgtcttgatgccatccattgctttaaaatgtttcacactgatgtctcattttgaagagcaatatgcttttctccagcattttgacttatttaatgaagttgtttctaataataaaaggacacatcttaggtgaagtatgtctcttttgctagactatgagttccatcacggtagtgatttctacattttctcgggataaccaatatcaaaattcgctgggggtatctgcccgttatgtgttcccctgggttccaaatctcacctcctaaataagaaactttaaggttgggaaccatatttaaaaagctcttcagataatttttatgtggttaaaatttgagaaccattgccccaggctagagatgaatgaactgcttgtttatggaaaattcaaattttggccaggcatggtggctcatgcctgttatcccagcactttgggaggtcgaggtgggtggatcacgagctcaagagaccgagaccatcctggccaacatggtgaaaccttatctctactgaaaatacaaaaaaaatagctgggcgtggtggtgcgtgcctgtagtcccagctacttgggaagctgaggcaggagaatcgcttgaacccgggaggcggaggttgcagtgagctgagattgcaccactgcactccaggttggcgacagagccagactctgtctcaaaaaaacaaaaaaaaaaagaaaaaagaaaattaaaattttatgggatataacagttacttaatatagccttaagaaaatccaagactgccccacagtcactaacagtgtccactgctccccctcaaaataaaagggaactaccaagagttgtcaaagagaggatagtgaagaggttacaaatgctttagggctgcccctcacactagctgcctgggtttgactcccaacttttcaacttactaagtttagtaaacatagacaatttatttagctttctgtgcctagatttctccacctgaataatggggataagaacaatactggttagacggaattacagtcaatacatgcagagcagttgaaactgcagcacatagtgctgaagtgctaactgttagatcttaaagctaatacataacactacggacaatgaaactaatttctaacctaaatatggaaaatatataactttttctacaattaagtctaactacattcaattagttttaagcaacaacaacaaactcccttaaatagaaatggttttaaattaatagcctcttcaaaaaagtaaacctttcagaatcagaccacgtggcttagtactgtcacattttcaacacaaggaggttttcagtgaggcactggggcagaacaaatttgcacagtgtctgctgtggacataagggatttcttcagccctatgcaaatagtaatcccactagttcccagaagataaacatgaagagacaacgaaacctttagctcagatgctcacttacttctgcttctctgaatttctcacctttggggacttgagaacaggctgccagtaaactttctatgctcttgcaagaagccctgatgcagttctattagaactaattgttacattagaggcaatatgagaatctaattcataaatagcatttcccataggcaggtctcataagcaattttaataccttttgttgagatagtttcagattcgcaagggaatactggagagtgcatttaccaacataggagaagagttacaataagaaactctcaaaaatgataggaactcaaaaatgataggaactcagcgtgctaactcctttagtcctaagtgccagaaatagggatacagagtccaggggcaatttaactggtcatgtgaagagatatcaagacggaaccagagtgaatttgccatgaatgtgactgaggtagattgtaaaaccagaggttctcaattttgaattttttttatgataaaagcaagttgttaccttcaatcaattcagattttctccatttcactgtaccatatcataaactaaataaaaagaaggtattttggtaatattcatgaaacaaatggaaaccaactgaacaagaaggcatttaaaatctcaaactttgtaaatataatagcgaaattagaaaagttttcctcatggtcaaaatgtatagcaagtatatttaaaaagtcttttatataataagcttggttaaactgaattgtctactgagagtctgctaaactcatgctagtagatgctaaaaactgtgttaaagtaattctctataactctttgtgttctgtattttatgagaaacagtaataaaaatagtttgtatatctgacatttttacaagggtaaatattacaaatttcataagctataaatatactagtattttagagcttcttttctaaaataagttaatcttggagaagataattttacattaacaatattacatctaaagtttctaaactcatggtgtgattataataatacatttataaaaatgtgcaagaagctaaatcaaacatttattcttttaacatttgaggaaaaaaaaaacaaaaacaaacaaacaaaaaacagaagtgggataggagaaggcagaagttttacaaggtttaactggtagacttcctggcaaacatcctacaaatactgcccaagcccatctagccttgcctataaaagtggtttgcagtgattatggagtaaagtatgggtcactaggatttacaggaagtatggttcctctgctctctggattggtgaggcactccccgtataaatataaatgcaccacatgtggtaccaatggatcatgcttagccaattaaaatgtgaatctataacagccgaacatagtaaactgagtcgccagggcattcttagtatcacacagtgcagaataattgccatgtgaaaacaaatactatctttctccttttttttttttgttcagtattccctattcttctattagtcaattactgacatctatttaacatagttttatttaaaggtgccatgggaatagacttaaactaactctgattcctactctcaagttgtttatggtataggaggagaaggaaaagcaaacaatgactataaaggtattttagttactatgattttgatatatagttgaccgagtgggataaaaggattgtagtcacttctacctttgaagataaaaggcagggctttcagggattacttcacagagaagggaatgatggggctgaatctaaagaagactggaagctggtcaatagatgaaccatgcagtgcatgtattgaagcgcagaggcagaataagctggattaatttgaagaacagcaagaaattcagtttagtgaggcactgggtactcaaagtgggagaggaagcagaagagatttcagatgcagcctttttttttttttttttttcagacggggtctcgctctgtggcccaggctggagtgcagtggcacagtctcagctcactgcaacttctgtaccccagattcaagtgattctcctgcctcagcctcccaagtagctgggactagaggtgtctgccaccacaaccggctaatttctgtatttttagtagagacggggtttcaccatattggccaggctggacttgagctcccaacatcatgatccacctgcctcagcctcccaaattgctgggattacaggtttgggccaccatgcccagtcccagatgcagctttttaaaaatacagagcaactgctatatggttcatcatgtattccaaagaatctagagttaagatctaaaacacagctttttagagaaaaaaggcaagcaatacaatatgcactaccactactataactgtggtaaatgaccaaataatttcagacaaaacatacttttcaggacagaagcattaagacatctttacttaatgcatagtgcttttttaatttaaaaagaaacatctgtttaaaaacacacaactatgtatgaaaaactcatttctaataaacaattcaaatagaaatcataattttccacctgggatcatagtttaaaaaatatcattagaaaaagaaatatattaatgtccagatataattagctttaaagaggtgtatggtaagaatgggaatatagtttagtatatattggcatgtagtatttttcttcaacagaaaaggctaaaatattttccacttgaataaggcagtattaaaaacgaattagattgtatgtaattcagcttctgtaactagaaaaaaggctgaaaatgaaaaaaaaaatctacttcttaaatcctggtcttttgaaaatgatttttgtatctgaaaaagctccaggtgtctataaatatcaaaaacgtttttatacacattacatacagacatatgaaatgaaatagatgattagttctttttttgtagcattctcaatcccactgttaacaaagttgttaaaaaaatccatgtgtgaaatttgtactacagaaatttataacaatttatgctcacttaattcccttttgggccgatatattctacattaactataattttcttaaaaatgcagaaggtatatggttttgcatttaaatatattaagttttataacaaagaaaaatcaaatagccatttagaaacattaactgtttcatgactgatggataatgcttacttgtgagttgctgccaaggctgtctgcctgaagttcagagaattttcatgggttacttatttcccattatctttcctcattttcttcactgttctttcctctccctccagcctaggtggtcatcactacttgcagttccaacaacaaggttcccacatcatcaagcaaaagtgttttttattttatttatttatatttttactgtaactcagggcagtacaaacctaagatttataaggagacgagacatatttttactgtgaagtctgagcatgacctgcactaggcctgtggagcaatttagaagtttctatttttaccaagtgtaaattggtaccagtagagtggggcactgctgaaaaaatacctgaaaatgtggaagcaactttggaatggggtaacaggcagaggttggaacagtttggagggctcagaaaaagacagaaaaacataggtaagtttggaactccctagagaatggttgaatggctttgaccaaaatgctgataatgacatggacaatgaaatccaggctgaggtggtctcagatggagatgaggaacttgctgggaactggagcaaaggtgactcttgttatgctttattaaagtgagtggcagcattttgctcctgctctagaaatttgtggaactttgaacttgagagagatgatttagggtatctggcagaagaaatttctaagcagcaaagcattcaagagctgtattgggtgctgttaaaggcattcagctttataagggaagcaaagcataaaagtttggaaaatttgcagcctgacaatgcaatagaaaagaaaaatcccattttctgaggagaaattcaagccagctgcagaaatttgcataagtaatgaggagctgaatgttaatccccaagacaatgggggaattgtctccacagcatgttagaggtcttcatggcagcccctcccatcataggcctgaaggcctaggaggaaacagtggttttgtgggctgggcccagggtccccggtgctgtgtgcagcctagggacttggtaataaatcgttacaaatttctgtagtacaaatttcacatacggatttttttatgaagtcaataattggggtttgggaaacactgcctagatttcagaagatgtatggaaatgcctggatgcccaggcagaagtttgctgcaggggtgaggccctcatggaaaacctctgctagggcagtgcagaagggaaacggggggtaagagcccccacacagagtccccactggggcaccacctagtggagctgtgagaagagggccaccatcctagagaccccaaaatggtagatcccccaacagcttgcaccgtgtgtctggaaaagccacagatgctcaaaggcaacctgtgaaagcagccaggagggaggctgtaccctgcaaagccacagaggagaagatgcccaagaccatgggaacccacctcttgcatcagcttgacatggatgtgagacatgcagtcaaaggagaccattttggagctttaagatttgactaccccaatggattttggacttgcctggggccagtagcccctttgttttggccgatttctcccatttggaatggccgtatttaactaatgcctgtatcaccactgtatctaggaagtaactaagttgcttttgattttataggctcataggctgaagggacttggtttttttcagatgagactttggactgcagacttttgagttaatgctgaaatgagttaagactctgggggactgttgggaaggcatgattggttttgaaatgtgaagacatgagattttggacagtacacaggcagaatgacaaggtctggctctgtgcccccatccaaatctcatcttgtagttcccataatttccacatgtgtgggagggacccagtgaaagataagtgaatcatgggagcgggtctttcccatgctattctcatgatagtgaataagttacaagatctgatagttttaaaaacgggagtttccctgcacaagctctctctctttttgcctgccaccatccacgtaaatgtcacttgctcctccttgccttccaccattattgtgaggcctccccagccatgtggaactgtaagtccattaaacctctttcttttgtaaattgcccagcctcgggtatgtctttatcagcagcataaaaacagactaatacaccaagtgacccatggtttcaatgcacattgaagtttgagaaataactgtttttcctctcacaaattctatggcacataaaaagggaacatattaagatcatagccacatttctaaaaaggtaagagagttccaaacccaattttctcagtgataaaatactagaactgaaaaaacaactggtgaattaactttcgaaagaaaaattgtgacattgccctagtattatactatatcatacacatcaaatatatcagcacacaacggtaatacatagtataatggaaatttctttccttgtattatgtaaatattatgttaatgtagtttttactttaataaaagtcctaataaaaataggctgtttggatataatataattcaaatggagtagttagcaaaccatgtaaggccaggccacatatgttttgtgttatgtttacccagcttacttttatcttttctggattcagagcatcctgaaagtaggtgttatcttttctctactgcctagtagtggatagagtgtagagtacacattcatgagtaaatgtttgtggaatacatgaataaattaatagctggaaattcaatgtatatgtattctagaaaaacacacataaacacatatatataaataaaaatcaacccataaatttaaaaaataaaattaatattttactacaaatagctataaaagaaaagaaaaacacagagaaattgacactgcatatcttgaaaataaataagaaatagttatactggctgaccctcagttagttagcaaagcacccagaatttaaaatacacttgttataatccaagacatatttctataattgtgcaaagttgctaattctaacatgttaatcagaaagaaaaactgatattctaggatgctgatgagctaatgtttaatgtagtggttaattattagttggaaaaaatctacataaagaaataaagctccaaaaaactagaaatctgaaaaaaaaaaaaaacttgtttaactgcatttaccaactctttaaatccagaaccagttatgagcattgtggtactattaataattgcatgctgaacatataaatgtaaaatggcaatttcaattttcgtttcatcaagacaatgaagaaaatgaaattgaatactaattagtgcatgtttgtcatacacctgaaagattagggggttactgtgctcattataagtgagtttaagcgaagtactcaaaggtttcatttgaaggactgaatataaataatagacttaggtgacaagggaaattaacaatgaatgatcaacacagaaactctggtatatcatttgatttcacagaatgtcttataggtgatttaatcttacaaaattgataaagttttttcttctaaaaaataacttagaaaatatgttattaaagaatgcattaacaaaatatatatatttgaacataatcagtaagtaattactgaataacaatgttgagactaagaaaattactcaaaaccatatgatcacatggaaattaaataacctactcctgaatgacttttgggtaaataagtaaggcagaaatcaagaagttatttgaaactaatgagaacaaaactacaacacttcagaatctcttggacacagctaatgcagtgttaagagggaaatttatagcactaaatgcccacatcaaaaagttagaaagatctccatttaataatctaacatcacaactaaaagaactagggaaccaagagcaaaccattcccaaagctatcagaagacaaaaagtaacaaactcagagctgaactgaagtctgagacatgaaaagccattcaaaagatcaacaattgtgaatgggagttcactcatgatttggctctctgtttgtctattattggtgtataggaaatacctagggatataacttacaagggatgtgaaggaccctttcaagaagaactacaaaccactcctcaaggaaataacagaggacacaaacaaatggaaaaacattccatgcacatggataggaagaatcaatattgtaaaaatggccatactgtccaaagtaattcatagattcaatgctatccccatcaagctaccactgactttcttcacagaattagaataaacaactttaaatttcatacagaaccaaaaaaagcctgtatagtcaagacaatcctaagcagaaagaacaaaactggaggcatcactctacctgacttcaaactatactacaaggctacagtaaccaaaacagatatatagaccaatggaacagaacagaggcctcagaaataatgccacacatctacaaccatctgatctttgacaaacctgaccaaaacaagcaatggggaaaggattccctatttaataaatggtgttgggaaaacgggctagccatatgcagaaaactgaaactggaccccttccttacaccttataaaaaaattaactcaagatggattaaagacttaaacataagaccttaaaaccataaaaatcctagaagaaaacctaggcaataccattcaggacataggcatgggcaaagacttcatgactaaaacaacaaaaagcaatgacaacaaaagccaaaattgacaaatgggatctaattaaactaaagagcttctgcacagcaaaagaaactattatcagagtgaacaggaaacctacagaatgggagaacatttttgcaatctatccatctcacaaagggctaatatccagaatctacaaagaacttaaacaaatttacaagaaaaaaaaacccatcaaaaagtggtcaaagggatatgaacagacacttctcagaagaagacatttgtgcagccaaaaatcatatgaaaaaaaaagctcatcatcactagtcattagaaaagtagaaatcgaaaccacaatgataccatctcacaccagttagaatggcgatcattaaaaagtcaggaaacaacagatgctggagtggatgtggagaaataggaacaattttatgctgttggtgggagtgtaaattagttcaaccattgtggaagacagtgtggtgattccttaaggatctagaaccagaaataccatttgacccagcaatcccattactggatatatacccaaaagattagaaatcatgctgctataaagacacatgcacatgtgtgtttattgcagcattattcacaatagcaaagatttggaaccaacccaaatgcccatcaatgatagactggataaagaatgaggcacgtatacaccatggaatactatgcagccacaaagaaggatgagttcacatccttggcagggacatggatgaagctggaaaccatcactcttagcaaactaacacaggaaaagaaaaccaaacaccacatgttctcagtcataagtgggagctgaacaatgagaccacatggaaacagacaggggaacatcacacactggggactgttgagtggggcagctaggggagggatcgcattaggagaaatacctaatgcagatgatggattgatgggtgtagcaaaccaccatggcatgtgtatacatatgtaataaacctgcatgttttgcacatgtatcccagaacttaaagtataataaattaaaaaacatctgataatatttcttagcgatacctatatttctttgagaaattgtgtttgtttttcaataaatacaccaattttgatttcagtctgaaaaattcagctcaatttactctgatagtttggaaatagtcctgttatgctattccatttaaattgttaaatatattattactattagaaaattatagaacatgagaacttaaggccctttttctttcgccaaaaaaaattagtggaaaccaagtcatctcacttttagcttgaattgaaaacaaacctacaacaccaatagttttatttttaatttgtgtaatccttttagaattattaatattcaatctgagttcagtacattgctgattggacaacactacatatcctccaatggtaatttaatgacagttactagtccgacctgtgttgcaataaacatactatatttttgtatttgagagcttaaaaatactggtcataaagaaattgtaagagctgtgaattaggctaattatatattttttgtaatctttaaagttctgacaacttggataagataattaacctgtttgattcaagctgtctaaatttataaagtgatgataattacacctactatatggaattattctgagaattaaatttaaaaatcacccaaagaagattaaaaaattcaagaggttgttactgaaaaaactaataaaatagatagactgctagctagattaataaaggagaaaagggagaagatccaaataaacacaattagaaatgacaaaagagatactactaataaccatcagcaactgctgtgaacacctctgtgcacacaaactggaaagtctagaagaaatggataaatccctggaaatatacgccctcccaaaactgagtcaggatgaaattcaaatgagtagacaaataagaatctctgaaattgaatcagtaatagatagcctaccaaccaaaaagagcccaggcccacatggattcacagctgaattctaccagatatacaaagaagagctggtagcatttctactaacactactccaaacaatcgaggaagagggactccttcctaactcattctacaaggctaacatcatcctgataccaaaaccaggcagagacaaaacaaaaacagaaaacttcaggacaatattttgatgaatatcaattcaaaaatcctcaacaaaatacaagcaaattgaatccaatagcacaactaaaagcttatccaccatgatcaagcaggctttatccccaggatgcaaggtaggttcaacatatgtaaatcaataagagtgaataatcacataaacataactaaagacaaaaaccacatgatcatctcaatagattcagaaaagccttccaataaaatttaacacctctcatattaaaaactctcaataaacttggtactgaaagaacatacctcaaaattatgaatcacctatgataaacccacagccaacatcatactaaatgagcaaaagatggaagcattcctcttgaaaacagaaatgagacaaggatgccctttctcatcactcctattcaacatagtattggaagtcctggccagggcaatcaggcaagagaaaaaagtaaaagccatccaaaacgggcagagaggaagccaaagtatccctgtttgcagaggacatgattccatatctagaaaaccccacagtctaggcccgaaggatctaggaaaccccacagtctaggcccgaatgatccttaagctgataaacaccttcagcaaagtctcaaggtaaaaaatcaacatacaaaaattactggcattcctatatagcaaccacagtcaagccaagtgccaaatcagaaatgccatcccacctacaattgctaaaacaaaacaaaacaaaacaaaaaaaaaacgaaaaaaccctcctaggaatacagcttatcagggaaataaacaatctctacaatgggaactagaaaacactggtccaagaaatcagagataacacaaacaaatggaaaaaccattccatgcttgtggatacgaagaatcaaaatcattacaatggccatactgcccaaagcaatttatagatttcaatgctaatcctatcaaactcccaatgacattattcacagaattagaaaatactatcttaaaatagccaagacaatcctgaagacaacaacaaaaataaaaccccccaaaagctagaagtatcacattacctgacttcaaactatactatagggctacagtaaccaaaagtactgttttgatactgatacaaaaacagacatatattccaatggaacagaattgagagaccagaaataaggttgcacacctacaaccatctgatcctccacaaagctgacaaaaacaagctatggggaaagaactccctaatcaataaatgatgctgggatagtggttagccataggcagaagattgaaactggaccctttccttacactatatacacaaatcaactcaagatggattaaagacttaaatgtaaaatccaaagctataaaatccctgaaagacaacctaggcaataccattctggacagaggaaatggcaaatatttcatgacaaagagacggaaaacaattgcaacaaaagcaaaaaatgacaaatgggatctaattaaactaaagagcttctgcacagaaaaaggaactatcaacacagtgaacagacaacctaccgaatggaagaaaactttttcaaactatgcatctgataaaggtctaatattcagcatctataagaaacttaaattttcaagaaaaaaaacaaacaacttcattaaaaagtgggcaaaggacataaacagacaattttcaaaagaagacatacatgcagccaacaatcataggaaaaaaaccctcaaaatcagttatcattagagaaatgcaaatgaaaccacaattagataccatcttacaacagtcagaatggctattactaaaaagtaaaataataatagatgctggcaaggttgaggagaaaagggaatggttatacactgttggtgggagtgtaaattatttcaacgattgtggaaagcagtgtgaagattccgcaaagaactaaaaacagaactaacattcagcccagccacagcataactgggtatatacccaaaggaatataaattgttctatgataaaggcacatgcacgcctatgttcactgtagcaccattcacaataacaaagacatggaatcaaccgaaatgccaatcaattgtagactgggtaaagaaaatctgatacatagacaccatggaatactatgcagctgcaaaagagtcagatcatgtcttttgcaggaacatgaatgaagctggagcaaactaattatccttagcaaactaatgtgggaacaggaaaccaaatactacatgttttcccttagcaccacttacagtgggtgctaaatgatgggaacacacggacacatagaatgaaataacagatagtgggacttacctgagggtgaaggatgggaggagggaaaggactaggaaatataactaatggatactaggcttaataccagagtaacaaaataatctgtacaacaaaaaccccatgacatgaagtatacctatataacaaacctgcacatgtacccctgaacctaaaataaaagtttcaaaaaaaaaaagaaaattggtaaagttttgtaaaaaataacattaaaaatatattattaaagaacacaattataaaatgaatacattgaatataattcctaaaaatttattgaataacaataatttttagtttttcacccattatatttgaggttctcactctaatataaaacctttcatgtttactttagctgtttttctctgagttcattatcatcttcagaccaaaagcaaattatcatcatcccactgaccttaaaagtaaaataagttttaactattgttcttaagagaataaatctaaatttttctcagtgttgatcactgtcctgttcgattaaggttatttctgcctacagccactgggataaagggaattaaaacttcacacaatactttgaaaggaagaatgatgcatagtgttaagtaggcaatactgggacaaagtaaagtgaacaatcggatatgaaacattaataaggtgtttctcagagtaaacactggaaaagcatgctacttatggtttatagaaagatggcaatcattgaagctcacgaacataatttgccaaacagaaaccctgatgtaaactggtgatatcatctctcaactgttctgaattttggctatgaatattaatgtctaaagttttatcatgaccacagtcctacaaatgcatttcaactagagtgattaaaaatgtctctggaatgattattcattagtaaatatgatataattattttctattattctgtgcatattttaaaccttaatcgatccttcacaagtgtgataaaactgtatagatgtgccatttccactatctggagttcattttgcacatgttgctatagattgaaaaagtcaagtgtaacttaagaagcaattttaacaacttcatgtaaatataaattcataatacaaaacaagaacttcaggcaaccttattagagctctatagataaaagaaatgtttatgagacatataagaatgcctaagaaatctgaacaaagaaagtatctgaaggagattttggcccagtttttcaagtatggaagtcttgcctcttagccataaatcaattttcgtttataccaaatgcctgtaaactagttcttgtatagtacacctaattatgtcacatcagggatttccatgtttctttgacttagaatacgtagtaaacagatagaacagatcaatcacctaaactaatcaaaactctgcaatatctccctactctactgaaataaggctaataccttttagtatgactcccgaagcacagcaaactcgtacaatgaatttgaacacatccctccagcaacctttactctagtcatgattttctacaatattccccagattgtcatgtagcatctttaatcaggctgttccctggatgttcagtctctactgaaagccatccttctcaggcctagctcaaaagctatctgccccaggtgagtttctcaagataattaatgaattcttcctctgaccacagaatactgaattcttcctccctttagtacacatcaatgacttgttagatggttattaatgtgctttccccaacagaggtttactctttcacagacatcagttttgatcatctttctgtactcctagtacatagttcatctaaatgctcaaaaagcattgaaatgtacagaaatataagctctgggccttgctaccccctctgggaaatcacttaatatttcagtatattgttgttttctcctgttttaaaaaatagctggttgatgagagtgaataacactatgaaatgaaacaccctcagcttgaaagaaggtgcatttgaggtattgttattatgatgcatggtatattttatacttgcatttgtggacccacttcttagagatagaaaacattgatataatttttatgttcttaaagtatcataagttgctgctaaacgttatcacagtggtaatgaacacacagtatacagaaagtctcctgctttgatatgcaccttaaaacagtgatatttatacctgaatatttttaacgtttttgatctctttaactaacttcttaatggaatgtgcatgttttttacttctcagaattgggagctaatttgaactcttcactaaattaccctttcctctgaccataaggaagagtcacactgagttcccttttgtctgctttttaaaatgaccagaatcatttaaaaatgacttataacattaaccttgtcccatcccatctgttacctgaatccacggccatctgtcattttctgcagctgtccacgcatttataagccccttcttattaagacgtgcatagtagggataccatttttggagtccaaaaagagctcggtgagtagaggaagctgtgatttgctggtttgatataattccaccttcaattcccagtgggcctgagcattctggaaacaaaaacaggaaaaaatatgaatgtattagaaacaatgcatatacaacatgtgtctgttcgatttgataggatttttttaaatgatttgaatttgcaccaccatgctatttactcttcatcccctttacagatctgttatcgatctctaaattaaggaaataattcttgcttctcatgaccctctcttccttctttgctttgaaagtagtcacttaatagacacttcccttctgcattatgattctggttctgtactgatagcttctggttgttgatcacgtcaacaaaagcataatgctcttaaaaggcttatctcatattttatattcccggagattagcatgcctcacaaattataagctctcaacaaatatttttccatccattatttctttattatcataaagctgagctttttttcaaagttatttttgtactaatttagcatttctcactactataaactttataacttaaatttttatacccaccatcagttatgcttccacaacaaaagggaaatgggtaaatctgttaacatttaaaaatattattataataccccatgatatattataaattataaaatatatgtagacaaattatttttataaagagagcaggtaaactctctgacaacattatacatgacaatgtgtacaactcagtaaatcaagatattaaaatacttattagcactttagtttcaaattcacaattctacatattgggattctgcatgtatatcttcacatttgcaactgagaaacttaagaaaattttccaatgaaattttaaaatactaagattaaaacacattatgctcaaatgatatgttctcagataccaaatgtatttagtttttcaaattagaaatggagataaatccatccttaaaaaattacatatatatttgtattatatataaaattatatataaattcttaattgcgttataaaatttcagcagaaggtacatttcttttaaattcagttttgaaaattcagaataagtagggatatgatataaggaaaagatgttcttaatttcattaacatttcatatactatactgaatattttgccaatttagatttgtataatatatacgataattgtattataaaaatatactacaataatttatcagaatttatgaaaataagaaagaagttcattgctactactaaatatcagtatatgaaagtcaacttgattggtgattatgaccaagtacattttagattttaattactgtcaaaatccaacatttgtcagtaattaaatgtttacacttagattgaggttgaaaataagaaaaaatattaggagccaaattataatatttttgaaacttagtaagatatttctcactgttaaccatatttttaattgtcataaacatggtaagtagctctgatggctttcaaatttttaaatttttttataaagaagataaaaatatatggataagtaatcatcttaatcagactgtattagtaaagacaacattaatacagtaaaaattgcatctttgccattgacaaaaaattacttggtatgataaatttagataataagatctttttttaacatgtaattaggactgcttagcactttatgaaagtatactatatcactttagaatcattaaattaagaagccattcattagtagaattgaagtcttacgagctgcagatgataatctgattttcacattcccaaaaacttaacgttaaaagttcagatattaattctttggacccttattttgctttccattttaaacttcaagatctttacagacttcataaacgtactaagaaactttcatgatgacactgtgactttagtaatggcaggagcctagctttttaataatattgtcatcaaaggggtctcaagcatcttgtccttagtttgtacaatgtttggatggaaaaatgaaacaggcagggagatcttttattgcaggccatttattgtaggccagtaagtagactagcagagctagagagccagaattgattaatgagctgtatggcagacttaaaaataactctgtgccatttagttgtatacctctaaagaccttatgctgaattagatatcttcacagaatttgtaactattttaaagcagagagtagatctcaaatcacaatatcctataattctacttcattgtttaatctatcaacctccctttagtagctaacatatcaggaaactcattgactttgaactgttgtatttatcagataagccaaataccaatgagcgattttgaaaatatatatgtgcaactcactctgccataaggttccaaatctttgctatgctctttagtcctgcatattaattctttcaaaaaacataattcaagctgggcgcagtggctcatgtctgtaatcccagcactttgggagaccgaggcaggtggatcacctgaggtcaggagtttgagaccagactgaccaacatggtgaaaccctgtctctactgaaaatacaaaaattacctgggcatggcagcatgtgcctgtagtcccagctactcaggaggctgaggcaggagaatcacttgaagccaggaggcggaggttgcagtgagctgagatcacaccactgcactccagtctgggtaacagagtgagacttcatctcaaaaaacaaaacaaaacaaaaaagcaaaacaaaaaaccctccacaattcaaataatatatattgacatgatatattatagggttatatcttatacaaagtatttttgcatgagctatttcattgccatgatgtcaaatttacaagtatcaccagtcctcgattctatattgttgctttaaacaaacaaaaacaaacaaaaataccccccaaaaaccaatttccaacagttgcataccacactctgtcacttacatatagtcaaaaaaggccaccaaaggaagcatgactgtgatggggattcttgaatgaagtgtgagtctgtgagttgtcaaggtactgccttgagttagtgattctgcattttcctactttttaaaatcggggttatgatgacacttaacttatcagttgtgaagaagacaagataatgaaagctttgcttttggagctataaattgctgaaaaaataatgagcttggttctgtaaggttattttcatacttctttttagaggacctcaactgaagtaatcctggctttttagcccctttcgagtaggagctaggtatttctcactgttatatccttagatgctcatggtggcttgtacacaggaaaagcccaataaatatgcactgaacgttgttattgggggctttttttgcttctaaacagtaaagtaataagcaaatccaagccttagatttatttcactctgcgaagttgtcacaacagcagattttcttcactaatcatgtggaccacaatcaaatggatgtcatcacaataaaaagttcaaaatccaatttccttttgcctgtgctatccacttcccccatatcctattaaattcaacagttataaaaaccagtgaaggaattacaattcagaatgcaaatgaatatacacctaagattaagtgaccttaagcaattaataacaggatgcttaaaaagaaagataatatgaaaatatacattgcttttactatcaacaaatgatagaagatatatgaaatgataattgatgaagtaatcaatgtcagatgagaactctgaagtttgaaaagtgtacccacatgtgttttctcatataatctttgaaataatacttcaagaaaaaaatgttttcaggactatttcatgaattagaaaaattgtgaggatggaagttaagcttgtaaaagatgactgtgtaatttaatgtggagagttcagtaattcttcaaaatttgactcggatcttttccttctgctatattatgtgaagcatacatacttatgcatcctaggggaggcaacaggaacattaacatggaatgaacatacaagatatcactagtaacactgaggatgtaatggagttttcacaagttgggatccactgcaacagtacataatgtatggcactgatatggtatgcctctgtgtccccacctaaatctcatgttgaattgtaatccctagtcttgggggagggacctgatgggaggtgactggatcatggggacgggcttcctctttgctattctcataatggtgagttctcatgagatctggtggtttaaaagtgtgtggcacgtctctcttcacactcactcctgctgccataggaagacatgcttgcttcccctttgcccttcccccatgattgtaagtttcctgaagcctcccagccatgcttcctatacagcttgtggaatggtgagtcaattaaactattttcttcataaattacccagtctcaggtagttctttataacaatgtgtgaatgaactaatacaggcattcagtcacagaattaaatacctacagtttatagtgtgtctgtctcctaaggtgttaaaattaacctgataccatcattggcttatactctgcttatctaatacggataggcaaattctgttcttattaatttattgacctctaagtatatgctcatccacccatcactccatccgttcatttaattcagttttgaaaatacgtgtttattgaagcccttctacatatttggcacttttctaggtagtagtgacatagggataaataaggcagaaaaggtctatgctcttaaaagattcacattctagtggagagacaaataataaacaaacacttaaacaagaaaataccatgaagtggtatgtgctatgaaggaaaaaaagaagggtgaatcaagtgtgggtgtcaggtgatcagagatggcctttctgagaggttacaccaagtctcatctctgaatgggaagaaggagctggctatgtttacagtactggtttcctcaaggggcttcagtgtaatggggagacacagagaaataagaacatttttatataatatggcagatattgtgttggtgaatgcagaagattcagtgggagaagagaagagggaataataacctagcttggggctctgggaatgattcccggaaaagaataggagcttgcatagtggagagaggagacaggatagacacaggcagggaacaggctgctatgatgagggaattagaggcagttcagtatcactagatcaagatgggttggtgggggaatggttaagagatgaagtggagaagtagaaaaatgctagattattttgcagaagacggtgatgatagaatttggttctgttagtgatggggagtttttgaaggactctatggccacattttcatttaatttagatcattcccactgtgccataaagagtagatttaagacgggacaaaactatgtccaaagagtaagctactacagttgtccatgtgaaaaataatgcagatctgaaagaggggcggagaagaggaagagttcaaaaatatttaagaggtaaaagtaggcagaactagtaatgattagatgcaaggtagaggagggaaatggagtgtttgaatttcaaagggtccagagagcaaacataggtgtttcctttcattgagattggccacgtttcacaaataacatcactggaccaaattcctctcttaaaatttatcaaaaatcattcttgctgttggattgaatgtgggaggatctgcttgtcttaccttccttctcttgctatactgattttggtgggctactctcaacatctctcatatcagtcaggctgcagggacaggattgagatgtaaaaatctgcttctatgctcaaaccatgtccagtacttccctggtccacaactcatccacatgtttatgtgtgcccatctgttttctcacaagatagagaacccctttgtaggcaaagattatattcctcacagtatctagcagcaagcttcaatttcagtgaacatttaataaatgtcggtagagggaattacttctaaaaaataaatatgaaaggtaaataaacaatacaaatggcaggtaatatggtaccattttatttgtatacttcatttttaattaaaaatcatttacacttacacttacatgctctcaaaggtacacagatatagaggccttctttagaaattttttttatgatgagtaaagaagagcacttgtttactatttaaaaaaaatgtaactgatagtggtctgtctgggtctcttctctttcaaatcgctgccacacagcattaccaggtatttctgaaattccccattgttacctctagagagggcatagtggcaattcgatcaatgctgaatacaaaaatagaatacggtagtagaatatggtagtctgcatttcctggctgtaagatctgtgtttatgcatccttggtattgtgcttgcttttgtcaggtacgacaataatcctaaattaatgagtccattcaacattggctaccagagaatttcaggcaccttttatacagtcatttaaaataattacactgcctgaattgtctgagtagactggaagtgccttctgacctgacaccctgctgttcagactaatactgagcaagtgagtcacctggcaggttgagcaggagcagctgggctagctgggggccaaacttcaagtgcctccccatagcaacttttctgctttggccaagagggatgtgaataaaatagcttcaaagtggagtccttctcactctgcaaattcattctctggagtatggcaaagaatggcttctgcattttattgatcttgcagctgacaagtaagcagtgcctcaagatgtctcgcatcttgttcctgagtgtgctgattaagcctttcaaataagtgagatgcacagctgaatccgcaacaggaatgtactgctttcatttgctctatctcaatatccagacatcttcagaatgaaaggatttcaaattaaaaccatgtaagaaacaaatctcctttaaacatctccagtcctccctttctccgagcatctcatcttatacgagtgagtcctctgctgtgcttaatacagcgtgataattgtgctgaatgcaagcactggtgaatggattagtgatgacctccagtactgcagaaattaatgctgattcaaatgtaagctttcctctgtgccacttggacaacagcctttcttttattcctagcatttgttttattttagagttgtcttgagaccaggctttaattggtgagggagggatcaaggctactctttctcacgctgtggcctgagggtttaaaggaaccctaaagttttttttttttttttttttttgatgagtcgtgtcagctaagcccccatgcatttgatttgatttctctcaaggctatcatttttctggtgtgttaggaagttgtatcagaagaaagaggtcaggggatggagtgaagatgagaagtttaagaaagggtgattcgggaacagggcctgaatattccagttcaggtgtaggagatggaaaaatggccaaaaagtttcccggatacagagtgagaatgtgaaggtaaacatgcacaacacagccttagcttcacttactcattcccaaattcctgcagagcaccccctgggtgtcagcctctggttatggcactgagaataatcaccttcaaaggaattagaatgaaaattccacttggtgatgttcatctctctccacactgagattgcttctttgtattggggtataaacattacatacagtcacagtaaccttccttaggaaaactagtaattgagaaatccttaatactgttttcaaaaattagttaaacttacttggattccatataaattgcacgtgtaccttaaagaaaaggctgtttcttcctatcagatgggcagcatagcttagataaatgctaatttttctcacaattgtgaatactgtgattctgtggtatttcgctgggaaaacattctctcaattttattacgacctatattctattattttccatattgaaagctcagaaggtgtccaggttaaatgaagatgaacagcaatttgtgcattttttttccctctgagacaatatgcttcttacaggtagagacgatgccttttgcattatttaggttttcaaagcacttagcacagtgcttacaaatgggcagctctcaatattacgggataaagtaaactaaaacaaatcattgctttttggaattacttttctttcttttttgaaggtggattagtcctctgaatgtagatattatcactctaaggattcaacatactgggtgggtgttaaaatcggaaatgctttcttcatatactggcaggcttaaaaatatataagaatcagctcttggaggtaggggaaatactatatttggaatgaaaaccacatttataaagtcacaaatgcaattatcagccatctagctatttcctttaaaatgtggctatgttttcttcacactgtgtgttatctcaagccaattatgatatattatcagtttaaattaattgttttcaattcagaaaaaaatgaagcccatgaataagctaaactataataaaaattgtctattaatatttctcaaattgatttgtgagcatattgatgcagaataatggttattatttaaatagtagagcctatgaactccagtattcaaaggccaaaattcttattgagataattcacaaaagttgacaaaatctaagacgattatcctcttatcacagtaaacagttctgctgtaggacaacagaagagttcattgtagtttgcttaagatgtattcttttaaaatggaagagtatttggatttttcatgtggtaaaaacaatatggattgatgaaacatttgtctgtaaagtcaaaagcctgaaattcaaaaacctgtagctgtacacctgttcttgctttctgacaaaacatatatctacataggaaagagctaagaagggtataatgccaaggttaaaatgctaaaagagggactgagttgcttgaagaaacatgagtcaaatacaaaatgtaaacatccatacagtgcttgtagaagacagattcctatgcttttaagttatttatatgttttaagattttttggcaaatgcacatcaggctacgtgccctaaggcattgcctttgatgtttggttataaagcaatattactgccatgtcaggcactgatttttatttgagagataaatcatagtaccaaacccaattaccagctatatctagttattttgttttctgtacaatgtagttatcttttcttcacactggatgttaatttaggtctagtatgaaattttagtgttccagaggtcaaaaaaaaaaaaaaaaaaccccaagagatgaaacaggaggccattgcaggtgccaaggaaagacatactgagctctgtctaatactagcacacttcgaaaagttgtggaagaaatgacagagagcaaaatggagcctagaaaagtatagtagatgatttgttcatttgaattctagagacatctatattatgcatttacttttaaaaatgtaagaaaatatttttcatttagaagataataggtaatacctgcataatcagaaaagtattaggttgggtcagggacctaaacattcttgcaattaatttcaaagcctgctctctaagtcacaacctcagctgtgctgtgtttcatctttccaaattaaaaaaaaattgccaacatttccagtataaagttgaaatagaggatgaattcttgataatatgtatttactaattgaaccttcctacaaataaaattgccacaaatgttttaaatattgtatttacagtggctttggtaatcctgaaaggaataattcaacatagaactttaaacataacaaatgtaaagctactaaaacaaaggatgctttaccaattttataaaagaatatcgagaaggatttaatagagtaacaattttattataaacctgttgaagctaagccagcttttcatacattatctcttattcagtagagattcatactggatgtgttttatcagtaatgaatatggatcagcctattgaaatatgaaagttgacttctgtttcttttcaaatttattgtacgtaataataaagtatactctgacattatgtagtatccaagttaagtacttatttttttttttttttttttttttttgagacggagtctcgctctgtggcccaggcgggagtgcagtggcgcaatctcggctcactgcaagctccgcctcccgggttcacgccattctcccgcctcagcctcctgagtagctgggactacaggcgcccaccatcacgcccggctaatttttttttgtatttttagtagagacggggtttcaccgtgttagccaggatggtctcgatctcctgacctcgtgatccacccgccttggcctcccaaagtgctgggattacaagcgtgagccaccgcgcccggccaagtacttatttttgttgaacaatatttgtagtaaaaacaatatacagaatttgctagtactacccaataatacatacatacatactaaaatctttagctgctgaaatgggtatggaatattagttgtgttcaacaaaatatccataatgggataaattactattttctaaaatgttgcagcagaatacattattgctatagagtttggcctagtgattaagtaaataaacaaatatacttcttataaacatattaaaaatatatgacaaatgcaaagttgtaaataatcctatgcttgtccattatgaagtagtaaattttgaaaaaaaaaaagcccataatagaattacctgcttaccttaagcttttaaagaaaagaggacttaatactttttttttcattttggctttataaaaaagactaatttcttcagaagctttcatcctgcaaatgttggctagctcaccactctagtaggttaatttatgggatgaaccaggaactaggtagggactataaagtcacaaacataaaatgatgcatattcattaccacaaaataaaaataacagaattaatttcatttctaaaaaattttgtacaaatgagaatagtgactgaattttcttagaaatcattattttttagtccaatgcttcaaaaaacagtaaatggatattttttaacttaatagtcttatggatacagcaggatatagtcattcttttaatatacagggaagataaattgcataaaaatacacaaagcaaaccagaaatataaattttaccttacattagtaagaaagtatctcattaattgaacatttttatttaattactaaaatcctcttaaactacaacaacgaaaaaaacaaaaaaaggaaagattgtgtgagtgagctaaaaattgctcaggcagggggttatggtaatatatccttagtgccttcatattttgaaaagttatcagctcagctaactaaagctacatagataaaagataaaaagaaaatagaatcactcagtttatatttatagattaattagattaatttataggtgcacaacttcatcagatcatacaatttacaaatgcaggtaatttaattgggaaataactacggtaacaagtatagtgtagtggtaacttataatatacataaagcacctcattgagtcttcacaaactttctattatatcattttatcaaaactgttcctcattggaattttggttaaggatatgaaggcaaatacaggtgcaaaaatctctactctgaacagaaccctaaagaaaaagtgtgtcctacttcatggaagcatttcagttgtgacgccagaaagtttagagttggaatttctaccccactacttaacagctgtgtggccttgggggaattgtttaatctttcagcagctccagattaatccagtggtgtacaaattttgatgcacattaggattacacaggaagctttaaaaattccaatgccaggccacatctcatacagtaccaattcaattagaatgccttggggtacgagccagacatatatatttttaaagttctcagtgataccaatatacaccaaaatatgggaactgtgctggttaataatgtgtattccagggagaataacacccattttacaggtttgtttcataagtttgaaagaatacatggttagcacatagtaaattatatggcaaccaatatacctttagtaaatggtagcttttacattgttgttgttttaccacaataaaacaaaaataagagataaaaagtcgtagttggaggagactgacctcttttactacctggagacacatggtttaaacatatgctaccagttcagccatgttttacatgcatttggttttttttttttttttttttttttcacagaaatgaaaatggagtagaacatctactcccatttcccatgcaaaatgttattcaataataaaaaacgtgaatacatacataagcacgattattaatcatgagctgttaccaaaaatgattcaaactatcatgccacttggcatctccttaataccatatttatcatcagatatttctgtcaccaaagcattcaaattgtcagataaaaatctctgcctgggggaaatataaactatggcttcttgtaatgaatgaaaatgaaatgattccccacagtttattgccagactcactggaaataaaaattactaattaaataatcttagtttaaaataggtctgggtctgtcaagcacttttcttcattgtggtacaaaatgaggatgtcctacggaaaagtttcatattaacactttgataaatcagattacaattctgaaaagcacttttataatcgagtttttcccccactttaatatctgagtaatcttatctttaggataaatggagataaagttttacctgctggcagttttgttggagcaatcaacaaaatctcatttcttgaattccacaaatgagagtaaagtaacaaaccatttccccccaaattgaataatacctgatttctgtatcttcagcatatccttttttttgtttcatcatgacttatatttgcaataaatttgagaagaatgttaatattcattgtttctgatttctaaggacataaaggggatgtcttgggaaaaaaattcacaaaatgccccttggtacccagccaactcttttcataatctgtttttgagatttttaaaaaaaactatgcataactattgatttcttatgaagtgtcacataaagaaagtaaaatgagacagtttcagaaaaaaagtatggtaaattcaggaattgcacacctttgcacaagagttgtcaaaagcacatgataaaaaatttcaggtggtacaataaaatattctggcttttttgttctatatataggagtgtggcttttattttgatacagaagtcaagtgggtggcaatatccacttaaaatctctaaagagctgagtgattattcttaatatatttgcatcttccttctccagtcatcaacctcagcattgcctagcacttggctgactagtggttgaagatgagatggatggaaggaagcttgataaaacactactttaaatattttatcattttaataaagattgttaatataacacctggagtttaggactctgtttccttactccttcagatgacacagatgccgtggcatgaaaatcatctaaaaagagcaatttttttccgttgtcattattaattacttgtccatgactaaaaattccgttttacaaataaaattagaaattcctaaccttcctattagttttgttcttgagtatatccaaatatcatcctgactggaagacagcattttgaaagtgtatcagtagcattagaaaacaaagatagtttaatcacatgaaaccaaaggaaaatgtctttatacaggtctctttttcatgaagacatgggctgagtatgatctttttaaggtttgactgcacactctgaagcctgttggggttagaaatactaagcactaagtaaaaaaaatatgaaaaggaataatgataatactaaacacctgtgttcctaaaaggtctgtaatttcagcagaaagattgccactgagtcctcattcatacatgccaatgggtaacagtgacagtagggaggggattactataaaatgaaaagtaaatcaggctgttttaatgatttagaattatattgtgctattgtctacagtatacgttatctgtacaattagtttattaaggaggtggatattctctagtgattatactctggtgtacatacgttgagcattccttacgaatctgggtctaacccctccaacttagtttcattgctatctgcttagttgctgaaagtgagaaatcaaaatactgataactaattcagaagcttctatctggaaaagattttaaaacaacaaaaattaatattttaagtgaagttgtgaataaatggtattagttatatcagctattaaattatgtgctaatttcactgcttaactcattctcctatttgtcctctcttttctcatctagccaattctgttgtagcccagaatctcactgccagtactaccgcctccttcttcttaatggcgtcccctttattgatcctacacactgcattcagaataaacttccccattatctgaccagttcactaacttagatcgatctatctatctatctatctatctatctatctatctatctacatttttttttcaataggtccccattggtcagaaaaaaaaaaggtcatcctcttggctgcttgaaatttaccttctagcaatatcaaactgcaaaccttagactgaattttacttagatgacagtgtaggaagtatttttgcagctcatgcctctgtccttttcttcgctgtcccagcgttcccccaaacagagttatttgtgccaattctggggtacaaaaagactctaagcatatgtgtatcatagcactgagcatttaaatatacttttaatgggcatttatgtatttaagaatttgtcttccacattagattgtaaattcttccaaacaacagttatatctgggtcctgaccgataaatgggcctattcctcgcatcttataaagagcctggaagtaacagctgctcaaaaacatcattgatcaatttaattgaggcaaacataacagacagtatctccctctaggatggttctctaccttgcaatgcaaactcttgcagcattttacccattctcacctcaagtgcacttcactcttgtatatctcctcatccaatatctttctcttctgcaactaagataagtaatatctaaatgtgttgattcccttgtttaggtggactgtccataactctttcctgctccccttccaaaggtatggatttatcttttctctcacagatcttcctaaaaaatacaaatggagcctgcacatacatactgcagagaaaaatatgtcaggcattttggccttaaaacaaccccatggagagtatctttttattattattattatactttaagttctagggtacatgtgcacaacgtgcaggtttgttacatatgtatacatgtgctatgttggtgtgctgcacccattaactcgtcgtttacattaggtatatctcctaatgctatccctcatggagagtatctttatttccaattgtaattgaggcaattgagactcagagaggttaagtaactcccctaaagtcttacagccaggatttgaacccaggtacatctattaccaatgggtcatgataaacattgtaatgacacgctgggggtgttctgtttgctgcatatgccttaaggagtgtggagaaactataaaaaatgatgaggagggcacttagatgtcttgtttatgaagatgtaggacagtgatctaactcactttgtgttctccgtcaccgttgttctgccgtggttggactaaagattcaacatggactgttattcattcaacatttaactaatatttattgagcctcttctttgtgcaaagcagaggtataacatttaatactttagttttctaagattgaaagtgattttacagctgaagcaggttattagaaactaaattcagaataattttataatgagacatctgtagactaggaacatggtgaactgcctacctcaagaacttctacagccttatttttcctctctctcactgtgtattttctctctacaatttaataactattttcacatttcctcttttaagaaagcctattacagcatagtgcatttttctctgtttaagaaaatgcctcaggataaattgtggaggcaattattttcaatgctaacatcttcaaacatgaaaccagcatctgggcaattatgacattagtctgatttagcattaaaaggtaaaagtttatgtataaatttcaaaattttaagcattattttatcaagaattttgtgtcccaaccacagatcatttttgttgctgtggttaaatttgtttctaatagtcttgtgtttcatgtatgtacacaacaatccttaaatgaataagcaaataccaattaaacattcatatatgcataaacttggattttgcctgtatatttctcttttctatcatattcacgttaatgtagagccaaggctcattatctgtgtcaacagattagaaagtaaattgagtaaaataaatcaattgattatgtttacttcacacaccttgcaatcatttgaaaagttagttttaactcccatttctcaaaagcatgactaattaataacatgaattattaactgaaacatgatttttataggtttttacttctctctagtactttattgttaaggtagaatactaaaaaaacatcatttcaatgagtaataaaagcagccttgtagacaatttacttgtctatccagctcctaaaatttcaaaaactgtatgtactgtcatattcttggaagcagtggaggtgtgactagagtgaaaaacagtagttcctttttacttacatgttgttaaaaagtataagaccaatactatgcagttttctactattttttcttttataaaattcagtttaaacttggattaaatgtatccagttgcctgttcattatgtttaaacaagtgtttatctgcttcccaattttacaccaatcaaaatagatgaaggtaactttctccctagagaattcttactaaactcagagacatcttagccactcgactgcctgaacttatcaaatgcccaacttatccaggtatgcataaaatacttatgcaggtattttaggtattaccaaagagaaaattaagtacactgaagaaacaatgtctattttaccgacaaattttagatcggaaaagggatttggccaaccagacacaagggaagacacgttgtagaaagaaccaagtaacaatatgtaaatattatatgcatagcctctgatggtatgttacatgtgtcgatttaaatgaactccattttagaatgaaataaaattgaataattaattttgtggttcccaagtattcctgttcagatatggaatacttttgtaatcagaaaacatgtttaagaaaattttaatggaccttttgttcaaaacaggtgaaatgtcaacagttttccaagtgaaaactctatcggagatgctattgtcacctgctaagtggcacagagatgcccactagaaattaattgatagataattgtgcattagaaaaattactttattcttatcatattggcttatcaacttcattggacagaattttatgtgttactttgtatattgttaggttaataatactgctacccaaggaacaaaaaaaaatagttttactttttatgattagaccaaataccagaaggacacggttaatagctttgtgggaacttttgtagtgttttgcataatgaatgaactcaccaaagctcctatgacaaaatcctcctgactactcaaaaggttaaatgtgtataaatagatgacattttcctatactatgaagaacagttgaataatactaaatgaattgttttccttctcaggtacacttataaactgactgctttcttggtgttaaccttttcatgcacaatcccttgaactacttattattaattaatatgaggaatattattaaatttaaattgatcattcatgaagacaaggatgcagagtaaaaacagagagaagcaaaagttctaaaagactatagggtctacaaataggaataatgagaatgagacagaggggccagaaacccgagtagtatgtaaaccttcatcgtaatgtggttaacatacaaacttgaaaatagtcctcattttacagaggtaaactgaatgggtctgttttcttggaatcaaaaataccagacaaatgtatgtcagagcaatatttccagtgacttaatatcagggatcatgtgtcaattattttgatgtttgtctcatcacttgcatgatgttattgccacagccattttgcaaaatgtctaagtttttagacgataagtcatttctattgttttaaaattccagtttgacacctggaagtctgcaaaagcttaacttccttaaagaaagaaggtcatgtcaatgatagcgtcatatatgtccgggaagcatacacttccttaaataactctaggtgtgagtgaactctgatacaagaaaggaactaaatcaaaaaagagaattacatgtgtgtttagtggcagtaccttgatgatttgaaactgatgtgcacattaactagaaatttcactaagttaacaggcggacattctccctccccctgccccaagtacggagtgatccccattactttatacataatcctatgattctgaaaaactggtatgttttggtgaactcttataccagctgcattattctaaagtgatggtgtataaggcattggaaaaccaaagaactaaattgattatgaaattttacatggataataatcacttttaaggagactgaaaaggttcggttgaatatgctcaacttcagatagcagcccctgagcagcaggtgatggggaaggggatgtgggggtgaacaggtgatggttgctctttagtttacctcttttccttagtcttttaaatgtgggttcaagtccatagggtaggtaatttagaatacatcatctctctacaggttacaaagtgactaaatctgcacagttgaggagaagcaggaatgaattcaataaaagctcaaccctgctagtaagacctctgtaaatacaatgacaaaaatattgcttacaatttcatcgtctgctattttacttacatgtttttatacatggagctagagaacaaaattcagcagaaaggccaggactggacattcaatgaaaatggctcattgacagcttttatctccaaaagcttcatctacattattttgggagaaaatatcttttgaaacagataaaccattaactcaggtttctaaaccttttttatagtatggacctttttgtcagtctggtgaagcctaaagacccttctcagaataatgccttcaaacatataaaatgaaatacaaagaaattgaaggcaatcatcaaaatatttaaaaatatgtgacttatcaatgtatatgctgatctattaatacattaagtagtagcagatctactatagtttcatattagtgaaaaatgtcaatgttattttacatttgtgacatgtattatgtgaaatgaaaatatctgtgatttctattagtgacaaaatcataggtactgctaacactatgattggttgttgcctatatttgtagttgatgaaaattttaaatttcagtcatccaataatacaaataaacagatgatttttattttctcatcaaaggacacttctgtccacctatcctttgcgatccttacctagggttaaaaaccttgcattaagcactcacagagtgggactgagaatgcccttatattaatccttgtaggaaagtgctaatgttctggtaaacggaaaactattaacagtggcagaatccagaaataattctattggaaaaggaaatagcattattaagttactgccaagtaagtatgaggcaacacttatataccaaattgtcatttcggggatgtttaaaaatttttgtgtctgcccaagtgtaccagagaaaatataaagcaaattttcttttgaacaaaccaccacaaatatctctggatttttcagagctaagagctgcggtttcaatttttcgggatttcgtagttagataatagtgctgagtatttataggcttccttatataactatagttctatccatttttcttgtcagaatagtttattttctgtccctgctcctgttttccttgaattttagtattggatttactgactttgctctggctctccttctttttatagaaccatattcctcaagttcaatttatttttaagttggatactttatgtttccattccctttggagctctaaaaagaacgtgtattattgaccagataaagctattaaggtaactattatgaaatttctttttaggactttagtcaccttaatggttctttggggtttaagatatgctcaaagtagagtgcaccataacctgggaggagcagcctgtggctattattttctactcagcatctgctcattctggaacacttgcaatctggcattcttctctacagacacacaattatataagggccattaatggttttagcttccacattaaaagtatcttttcttaggcctgcattttcttgaccagttcctattctggaaacactcttttccttgctctaattctgtattcctcttctgtttcttggattatccttttattttatttttttcgtacctttgcaaatagaacttcttttgcctgatttaaattttatccttagccatttatactttttactctcttactttctcccttggcaatgctatctaatcttatcacttcatcattctcatgtgacctgtaaatctgaatctttgttaccaatgctttccttaactacaatatgcatttttaataactagctgtactatcttatcaggatgtcccaattgcacctaaaattcaatatgcctaagcagtgaaaaaggttgctgtgccctcattcttcagttgaagaagattgctttgaaggtgggaactcaaaacatgtatttggctttatgacttacatgctgctggaaaccattacttccaagtgtgctgattcagttgaaaactgcggctagggtcacactagctgttgctgtcactgccaaactcagctccatagttgccagtcaagttttattgcaaccatttggaacccttgagagctcaggaaatcatgccatcgtttgaaaaattgtgcacatttggtgaaagatcaggaaccatctatattctttcttctcttctgagaaaggcgtttgtctctgcttttatcagcagtgtgataaaagcggaaatcccggtggtttgtgctataatttccccattgtgaaataaccaattgaacctcactctgacagtcggcccaaaatttcacctaagtacccaagaacgccacattaacatgtagaagatactgtctggcccacaaattaacaatttaacagtgttccaactttctagtcccaggatgacttcttttctagtagtttcctaacagagaggtttttttgtgttttttgttttgtatatattttatttgggttgtccccctgctccttttgtaagggtgagggttggagtgatagctgaaagagtgatattttcagtttgagaaaaatgcaatatttttcaatcatccactacagttctaaattttatgagaactaaatcaagttatgccgttctcaaactctcttgatgtctgagtacttcatctttctttgtctttgaactggaaaatataagagcaagttttagcctggagaataaatgcaaaactaaattataatccctggacatatacagtttagcacataaggggaatgttgaaataatttgaaaacaaaaacttcttacggaatgtttcagtaattatttgcaattaaatacaaaactgtcaggtaatgagaatacgactccatttgttggaagtatttaacaagtcccacatggtctatttgaacattttgcagatacttgtttgtctttcctttactacattataactttaaggtacagtaggtgaaccttcaaagtgtgataattctgtacaaaactgttgtgtaacatttggaaaatcagaggcatctgaaggaagatagaacttccatgtcaggcacaaataatccaatttgcttttgttattgagtcaattttttgtgtttattgtttcaaaaacttcatcctgcagtaacgttgaaattgtttctttctttattgatatacttgcatagagttctggatttttttaactcacaaaaatatgttttaaaagaagtgagaaattaagttaaaataattatatattcaagtatatatggttacagttatttgtaaatgtatctctatatatttataggtagattttaaatgttatgcacctcagatttacccatagtcaattcctttatttatttatttttaatgttcacaaaaggtatcagcctgaggcaaactgtccttctgtcccactggagttttggattaatttttattttatgtatttcaagcaaagtagaacaatcttaagttaaattagccaatgctttcagagacaaaaatcattaccaaagtaccctgttcaaatttctaaaacagagcagatatttgttatatggaataaaataggattaaaattaaatatttatttttctttgtttctctttgatttcttgttacatttacaagttaaaatctattctgatgttttaaaaatcccttgtgattgcacaaaaacatatttataagatgaatttttagtatataaacatggtttggcatggacagatcacaaccccaaatgaaatttcatgactctatattgttaaggcctaaaagataagatatactaaaggtgctatcacatgttggttaaataacaatcttaactcatccactaaatattaagattcttaaagacaaaggatctgtttattcttgaggataaacaaaggatgtgtttattcttgaggattctcaaaggatctatttattcatcattttctttgtaaaattctcatctctaccacccctcctctttctgtttgagtatatactatacattcttatggtctcggctttcatgccactttcctaactcccccaaacaaaaggcttccctgtcataggctccctcttttttgccctcatggcacttaccatatcttatcattaaataatacataattcttttttctctctcattaatctgtatattctatgagagtaggaactgaattcatttcaattaccattgttgtcccggctttagagggtgaaacaatttgttgaatgaatgagtttattcatgtatgttcttgtaatcttgtacacagttacgctaagaaaagctcagtaaatatttgtggctagtttatttgatcatataattgaatacattcactatattgcaacatcagacttaggcagttttcttgtaaaacttatgtgtgttttcattctaattttcacttccttatagacaccttttttaaaaaaattatttacttcagaatttctctatgttttccttttgtcttgtcacagctggatagggaagagtaggaatttagtattatattatataaaactataatctctgaccactttttaagaaaatactggaattattaattctgctcttgtaattcactaaaatcactgcaaacattcatttgcttgtcattcgctaagatacctgatcaaataacagtgacatcttacaataactgcaaacatacaaaaagataaatcaaattgggtatttgtagttcatatgttttgatagccttttacaaaaaacacagcaactatctcctataatgattttgggtaaataatatttatttaaacttatattaatgccacaggaatttttaaacttatgtatctgtaaaacatggtatgtaggcattatacctaacatctacactgcttgttctcaaggacatacactaatttactaaagaaggacaagttgtttgcataaataataaaacttaaaatcacacattatgacaaaagaaaaggtgagatatacaggtatttttttttcaaataactaaaaaatcctatgtatatatatttatgcaattatttctttataacagttattgacctaggtgttttactaggtattttaggtattttacatatgctatgaattttaatctgcctatcaatctacatccatcaaaagatagtatcaattccatctgcagataaagaatctgaggctcagaaggggcaatgtacttgtcaggacatatagttacaaatagaaaatgtttaaacttccagttctatttgaatgtaaagcctgcactctttcctcttatgctgttgtcacttgccaaggccactcatcaagtgtaagtgtttttaatatgtagagtataataacagcatccctttaccctacaaaaaacaggatcatatcatgcttagggctgcaggctctgcaactgcaatgcctgggattaaggccaggttctgaagtttactagccaggccaacctatgcaaattaatcactcaatagctcagtctgctctataaaatggaatcagtagtaaagagtatctagtacaaagaatgctgagaggattaaaaaatcaatatttaaagtacttaggaaagtgcttgacacatagtaatgcttaaaatcaacatacatgaactggtgaaaagatacagtttagtaaacaaaaaagatttgcctgtcattatttataaatttgtcttttaaaaagcaataattaaatattgagcataacaatacaaatctcatcatgtatttatctctacaatgtttcagcaattttcagtgaacaagtatgtacttaaacaaatatacttggtagtacacattgatatcaaaagaaagaatataggggctgggcaccgtggctcacacctttaatcccagcactttgggagattgaggtgggcggatctcctgaggtcaggagtttgagatcagcctggctaatatggtgaaaccccgtctctactaaaaatacaaaaaaaatagcctggcgtggtggcaggcacctgtaatcccagctacttgggaggctgaggcaggagaattgcttgaacctgggaggtggaggttgcagccagccgacatcgcactacagcactctagccacctgggagacggagagagactccgtctttaaaaaaaaagaaaaaatatatatataatatatctttttttcatatatagtatatattttatatataatatatattatatatattttatataatatatattatatatattttatacataatatatattatatatattatatataatatattttatatataatatatattttaacatatattatatattttatatataatatatattttaacatatattatgtattttatatataatatatattttaatatatattatatattttatatataatatatattttaatatatattatatattttatatataatatatattttatatatttttaatatataatatatattttatatatttttaatatatattatataaatatacacacagtatatattgtctatgtttatgtgcttggaaatactagctaatttataattatggctaaaacagttaaagctgctcaaataatgagataagaaaatattaatttaccactttcaaaatatattcataggtattattttaatatccttatcacagaattcttaaacaactatataattatctagattattttattaaatttgcaaaaactggataattatgatatttggaaacatcacttagtccttactagaagattttagttttaatttttagtaaaaccctctgagatcacccaagtgtttttttgtttgtttgtttgtcataattgtttgtggatgttgcattataagagctcccttgaaatctgtcttactttcccaaagtagtgccagtgataaaaatgaatttgagtggcattcctgaaatttaataatgtcatatttaaacaaccaggagggaaatgtatacaggtattgtgggccacatagtccaataaatgagaacaatcctagttatttttagattagttaactaaagtgttattaattttcattgcacttaatctagtttaaacatcatgttcagttaaatttacatgacaaagcttatctgttcttatgagaatagttttctcattccaattcatcatcattttcaagctgtttatggaaataactgtcagaacacttgagcttataacatttaaaaggaatgagggtctgcgcgcagtagctcatgcctgtaatcccattactttgggaggccgaggtgagaagatcattcaaggtcaggagtttgagaccagaccaaagtgctgaaaccccatctctactaaaaatacaaaaaaaaaaaaaaaaaaaaaaatagccaggagtggtggtgcgtgcctgtagtgccagctgctagggaggctgaggcaggagaatcacttgaacccaggaggcagtgagccgagattgtgccactacactccagcctgggcgacagagtgagactccatctcaaaataaagaaataaataaataaaatgaacaagggaattaaattaggactttaattagaagaattgatgtaatggtgtgataaatactacaggaacatctaaatgattttcacatattaaacgtaattttatgtaaaatataaaaataataaaacttaaccaaaccttgtaataaataaataaataaataaactaaaaaagaattgagatcttccaaagtaaataaattgtatgaatcacatctagaagtctaaactgaaattatttaaatcagaaatatgtattattgccttaactcccctataagtataattagaaaataattacttaaaaaactacaggaaactttttttgcctagtattaaaaggtttattattaacatgaaataatttcattgttattgaaaatgttcaataggtaattgatttgcataataatttttaccatgtaattttgcaacaggtcataatagagttagatataaatttattccttacaaagtaaaggtgcttaatagctaaattaattaaagacacacattacagtaaataattcacagttatttttgtaatatttatcaaggtaatatctcaacaaaaacatcttgcttttaattgtttaacttaaatatatttgagtttttaaaatgtggtatatcactagttttgaaaatatttcatttaattgtattggcaaaggcagccttaatatacagtttaaaattgaaagtctggtaaaaaatgagggaaaggctgccctctgggacatgcatgatacaaagtccagaagaaaggttgtcaatcatattccagggtagaaaccagcacaggagttatcatctatgtattgtcaacaacttccaagatcttaccttcaagcagcttagagctggtaccacctgtaacctgtaggtgcttatatgtaccccacagtaagcaaattctctaagttctccatgtgcaaaactaaatcattacccctttttactctagattttctaaaatctcttaagagactacagaaaaaagtagaaccatatcctaagaaacctagacaatagacagaataaagatccttaatttgttatatgtccttaaaatttaataaaataaaagcaaacaccccaataggaaaatattttagggaactctctaggtgactctttctgatctctttgtcagcacacggagaatacaggaaatgctagaatgccagatcatatgacagttgaagggaggcatgccactatcacatgcatcttcaaagagatgtctgaatttaaatataaatgttgtatcaatataaagttaattcacagaaaagcaaaggttttcattaaacacaacatgaaaaactggttggaagacactaggcacaaactaatgacagggcaggggcctctctccctctttcatagccttactgtctgtctcataaacccttcatccccagcctatccactcgacctgtttccctattcctccatgccctagagctccacattctaggtctcctcttctaggatatccacaccctcatgtgccacttcttagactcattcatcactgcagagtgacactcattcctaggcagggttcttatgatatgtcccccattcaatcctccttttaggaaaatgggaaggcttctcccccgcaattgttcccctagtcaggcctcctatgggtcagaggtggtcttaccctgcctagacatgctctaatccaggtattgttttaatctatgccgaagttccttcctggaaggttctctattcaggtacaaattctctatttttgctgaatgaaggtgaaatagtcactgacatcagtttttttgttcatcataatattaataagatgttcactgacagacatcttggaggtgctttttagcacaacttccagtgttgactgagcagccatcttcaaattccatgaaacagaaatggatgcaagtgctgtgcctgggacaggccaaagagaagctgaacctgagcttgagttaacttagtgggtgattagttaaatgcttcacgggaaggtttctaggttagttggttggatgactattggtctagttggctgtatggtcaacctacttactcagccttccctttccatccttctgtgccctgcacctttcttcatcaactcatgctcaatgtccttcctcaattactttaagcttagaaagttttttttttcccaattcaagatttctctatgatattcagagtttaattattttgtgtggtttgtcaggactacagtaatgagcatcccattttatatcattattttatttatatatacttatatatcattcaacaatatttcctattttattttataaataccatggccaaagagaaagaaagaaaaagaaaatgagaaatacatttcttactatggctgaagagaaagaactatgtggtatgtgtctgtgtctgtgataaagaatggacgtgtcatgtatattcatgtttatattatacctctctatttaaacaggtatctcagtcttgaggaaaatacactgagtggggaatcagaaacctgtagcactgcttctctcactaaatagctgtgaaagcttgggcaaacaacatcaggtgtgtctcagtttgtgcatctgaagtctcatctgcatctacatttggaatttgcataatgttgttgtggtgctcagatcatacgatatacatcgaagcagtagcagtatgaactttcctctaattgtccaacaattataaggctatagcactagtattactaacctgtgtttgggcccattttaggccccatcccattgactttagtcctgttactacttttttcccagctttttttttcttttttaggtaagtggtgctttctgcctctttgtaaacacttaaggcaaataactgccctgtcatttgatgcatcatttcaagaccctactttcttcagcttccaataagacaaataaatagtgtgcaacattcttgctagcgtgtgggacggcccaaatgcatcctcctttatttttacgttttatttataacagaggctaactgatttattttatttttatttcgtttcttttagagatgggttctcactgtgttgcccaggatggtcttgagctcctgggctcctcttgctgaggcctctaaaagtgctgggattacaggcatgagccagtgtgccctgtctatctggtttcaatgccctgaatttactctcagaaccaaagtgtcactttggtggtagaaatttcagtcatatgcataatcataaaccaaaatgggattcgtggaacttgagtatctgaggaaatgttatcattcttttcaggtcacaagataccatttctatgcatattgtgcactaaatgagacaccctagagaatatgtgtgcattaataacataccacaaatatgaaaagtgccatttcaatggattatgcactctgaaggcaaataatattgattttggcccagatttcaaaataaatttagatgatgtacataaaaatatatatgcatacatatatgtgtgtgtgtatacatacacacacacacacacacacacacacacacacacatacacacacgtgaatacttactgtattgacaatttcttcccataaattcgcctgggcactcacaggaatagttagcaacaagatctgtacatattccaccatttttgcaaggctcaacttcgcattcatttatgtctaagaaaaacagaaaggacagaggaagagaattattggtaaaaaatgattagatattggaaagttttaacatttgaaatacaaatgtcttagtaatgctattcctttgtgtgtgtgtaggcatgtgtgtgtttagtcagtaatacaaatgctgcttaaaaccaacaatttaataaccattatatttaatcaatttcaaataaaattcagaatacagacgaaaggccaatggaactaaaccactctcccattctgaaaataaatatgagtagtctggggaaatattcagtgtatccttagaattaaatcaaacaaattaaccctgatagaaagatgaattggtttcacttacaagatcgagaaacctcccctgcagcaacaactgccaattaacactgtctcatttcatcttaattcattacaattctaactgacagagatgttttagtttctaaatagttcgtctttgatgaatacgatgagaagcaaattagagttaatagctaaagctcgttacatgcaaagtataataaatgtaaatggtgatcacttcctaatctcattcaaggatttctaaagtgaggatgactaaagggacttacctttgatatactactattacatctgatgcaaaatcacatgaaacataaaacatcgagcaaattatactactttccttgctaattttggacaacagagaaaacaaatatgactttgaacacaaaagaaacaatgactaattcaatcaatcacagatattcacaaatcattcccttttagcaaagcaccatgctggattctgtgggagccagtacagtagttggagagcacacaccactccccatctcttcctcatcctatgagctattccagttgagctccctatctgctttcatttccataacagtttgttgttgttgtttttaactgtattacagacttggaaattgtctgtttatatttagcccctttcaccttgtcagaaagtgagctccacaaatgaagttcctatcttgccctgttccttgtattcctgaaaatgccacactccatctggaaaactactgaggctcaataaatgtttcctgaccaactttctaccaaaacaatagaaatagtcatgtgcacaatcttaaaacattttattccagatttgtaatgtgccttctgataccctataacatatcaaatgatagttctgaagtcttgggctattacagttgcttaaagcaagaagatcattaaattacttctaaaaggaaacaaggaaaaaagtatttgaaaatctcaattttgccctttcttttgacattttttttttctaattagtatcccctccagaaagcagagttggtcaacttctcattctaagttcactgtagaaagcctggtctaaatttccttaggtaataactttctctcaaaaagcagcccttttggtttctggttgacaatcatagcttaagaacagagataattcatgactgtgttcagaaaaaataaaaataatttgagtacctcataacttcaaataataggataaaatcagaatctgctaatctctaaaaagatggatctgtgtgctgtaaagtatgatagactcagccgggcgtggtggctcacacctgtcatcccagcactttggcaggccaaggcgggtggatcacaaggccagtagttcaagaccagcctggccaacatggtgaaaccttgtctctactaaaaatacaaaaattagctggtgtggtggcgtgtgcctataatcccagctactcaggagactgaggcaagagaattgcttgaaccctgaaggctgaggttgcagtgagccaagactgagctacttcactccagcctgggcaacagagctagactctgtctcgggggaaaaaaagtatgatagactcctaaatatttgatactgaacctgtacaaaaatgaaggatggatgggagggagggagggaggcagtgagggagggaaggagggagggaggggaaagaaaaggtgagtataagtcatttctttcctttttaaaaatataataaaatctcagctctctttgatcttatcaaaatttcacttagtcttaatattaaactatatttatattggactaacacacaaaccattttcattaaattttgtaagccacatgaaatgctacttattgttgccaactcaattatgcatgacaataacaatgtttggctaccttggaacatgcccaatatgtcttaacctgtatcctctctactacaatttgttttagatgagaacgtgtaactggttaatgtcttcatatcttagagaaaacactgccgtattttgtaaagttagatgcaaaaatttattctcatatatacttagagagaggaaactaagtggtcatgtctgaaggacccacataagcaaaagataatttgatcttagacaagaagaaaaagtttaattaagactaataaggatgtgatatagatgacagtcaatttccaagcagggagccagaatgaatcacaactttgaagaagaatgttcatgatatgatcgtgtgtttaggtacaggagtaaagcattttggagcagagaagatgaaggagagtgctagaatcccatgtcagagaatgtagatagggaacagattatgatgaacccttagtgcaggctgaggcaactgcgttttatttttttggcaatgaacatttggagcaggatgagaaggattaaagggtatttccttcacccttctactttagaagaacctagtgaagccatatgtgagatggacttgagaaatgaataaaggaagatgggacagaaacccacaaaagatttgatgttaataggtacaacatatattttaagtctcatgtaagaggctctatatattttctcattttaagattgaaatatatcatgagtaaaatcaaacccagctcttgctgatttgtaatgttaatagaaggaagttctcatagccagtgtgagaacaatcaataattattatacatactattaacgatacaaagacactgctgttttttgcctccttaaatcttccaagtctttacaccgtaagtagtaattaaaatatgtgagcgtaaatctaattgagacaaatcaacctttaaaccttccagttataggctcatcaggccccatctataaatcatcagcaaagcaagttataattaaggacatccgattctaaaaaatcaacagttaacacctttacccagaggttaagatgaagtggaatgaattggaatgcatttgctgaaatggaaatgctttgtagacacactcaatttgtgatagaatgaccttttcattgtttaaatgtgcatttttcaatgtttttaaaactcaaaaactacttaaatctaaattcataaaaatatacatgttatcttaagttatccatattttttaatacagtagctaagttagtaaaacatttctgcataggtacatacccagtaatacacaagcttagaagacagttgcaaattacacagaagcatttacgtatttgtataatgcaggagttctttcagcagtgaaggctatttgcactgtaattaacactgcaagcaatctaaatggaaactgacctcaatttgtataaatcatgtttaattaaagactagataaaaacgttcacagaatatagtgcaatgaaatgaaacttaaacatatttgcaataaataacatacacctatcttcgtcacagatcaagacattatcattgccagaaaaaagtccacatccattccaaatatactactaggttataccatttaattaatgaagaaaaaactgataaagtagcccccatatgaaatagaaatttccatatttggtcagatttatagtttatttataataataatatcatttataaggtcttgcttcataaaacagcttcaaaatatgactttataatcaagacagtcagctgagtcctgaagttataaaactttgctgccaaccttcttgtgtcactgaggcacagtgatgagagctgcacatgagtttccaggtataaactcatgactcacccttgtttcctgaaattatatataatatatataatttcatatatatgaaattatgaaatatatatttcataattatatatattatatataatatattacatatatgcgatatatatgtattacattttgttttgattttttggtggaagaagaaagaagaagaaagaaggagaagaaggaagacagaggacagaaaataataaaaggtaaatagttgaatttctctgaaaggaaacacaaattactttgaaccaaaaagtactttacaagtattcccagttccttgcctctgttataactaattacacagattcattgattttatatgcataactcagactctttatcggtatgtcatacataacccacattacagatttgtaaatgtgtttgatcgtccttctctttggcttgggttttttcctagcagaaatgcacactctggagatttcgctgtgagaagcctactccagtaattgacaaactactcatatatatatatatatacacatatatatatatatatatatacatagatctatctatctatctatctatctatctatctatctatctatctatcatattgagcactcctcccttaggcaattcaccttatgcacatccacatcctgagaaatgctcagttacacctggtcttctttgtcctggatctttgtcagaaccattattgtacagattatagccaaaagcccatgaaattgactttggagtggtaggctgtcaaagagtttttaaaatggaaattatatttgttaattccttattggtgccttcaaaacaatgcattgtctgggcatgacttcttgtcacagaaactgtgtggcttcttctcagagaattatattgaaaaattcaataatctcattcttcattacagattccgctagttggccagagatgaaacagagaattcttgagtctaattcccaggaatctccatctctggagacttttaaaactaattagtaagtaattaattagtttgttttcaactggctcacctttgcaatctgcagagtaggaatggtagcagttttcacttctgggacatcattatcccagttcatccttgagttctctcagaactcctcaggaaaatgccatctgtcctcagtagtttagctacatttaattcaccaacatggcttagatattttgaatactgaccaccatttggaccaggacatctaatccttctggggatagatatctatctaacctcctcctagagaagacaaagacaatgtatttcaaccataaatctatctcctcttcataagtaagtacattgaggcccccaagaacatcaagaaggaacatggttcttgggctgaacatacttttttggatatattaaaaggagacaatgatagacggtgcccccccccccaagcttttttttcttttgcgaagacaaatttctcaacttctttatgtctttcccttgggctatctttcctccggcaatattgttattgactgctaattgcttggcaagaccttatttttcagagcctgctattttttgatccttaacaacacatcttccctgggctccccattagctattacatattctccagacctcccatgagtgattgccttttaaagtttgaccttttatatttttccttatttaaagcctatgatctttcaatttctctttaaagattgaatttctatttaagatgaatttctaggaatttgattctcccactcagatgctgaacttaattatgtcacaatcagaattatctagataatttatttcccagtcacttctgtgaccagtttagtatatatttgaatcttctgttcttgaactcccttttgatgtggctttctgctatattactagtaattcattttaaagtggctaattaaaatcagcattattcagtcagaacgtatcacacacaaaccttttataataatttattgataaccttcacttacaagaacagtagcataacaaaagccccaaatccaagagatatttatccattgtctccatctaataaagatcatattctctgtccatctctatcctgacatcctagtatttattttaagatctttatttagatgcaaatgcctttgatactagtacgcaggcaatattcatcccaattatctgggttgtttatattaattattccaataaagttttatttgcatttacacagatatttggccagtatgacaagacagctattccaagggatataaaagccaaaatgaggggaggtagaggaggggttatcaagagggtgttatgtctctataactcaaatatttgatgactttaaatatatatatatatgcagaggccagtaagaacagatgcctctttcagtaaacattttcacaaaagagcaaaccacaacaagggatgttacctcagtggcatgtagcatagtcactggccctgcaataaatatttgttaattggtaagaaagaaccgggaatattagtaaccttgggatcatcatgtatgtactgtaccagtgagtcccttgcttggggcaggtgctccagcctatttctaatgggattctattaaggaaaaatgaaattagagcaatgcttcatttaaaagttggagctcttaaagcatatcaatgcacaagtcatgcacttagagattgtgacttaaatggtcttgggagagacaaagggagtaatatactttttaaaaggcattccagtgactctgaagcatagccaatgtttgcaaacactgaacagaacctctgcttatgaagcacatccatccatccacccttccttctttccttgcctcccttcctccctcccacccttcctcctttccttccttccttccttccttcctcccttcctcccttctttccatgcatccatccatccttagttctacactaggtactaagaatgcaacaattaatatgtcacaatctgtaatgtttctgaagctcttacagtagagtagatagacaaggaaacaatcagttacagtgtaaggtaacaagggctataacaggaaaatgcacagactctcaaaggaactccaaatatcaaaactaaattggtctggcagactaggggatgttgagttttagagaaggagtctagctgactagggaaaagtgcttttgaattacatggagttataaatagttgactctgtaaagttatttttctaaattaatgtgtatttcatttttcctggtatcagttgtctgcagatctaagagtgactcctcattgtcccatagttcttttctccaagtgtgtaaggtatatatttcctggtttcctatttttattattatttatacaattgcatattttaatgttttatctaaaattaactactctattctttcagctgcatgtcaaattagttctctctctggttttagcagtcaatcttaataatcaaccattttggagtttttcctatagtgagttatcagaaaccccaaactggcttaggtgagataggatttgtattagaagctcagctatgattcacatagcttgactttaaccatttgttcactcattcattcattagaattctgagaagcactttccatgaatcaggcattaaaatacataattggatatatctgtaaatagaagcagctcctgttctaagagatcattcattttctattcttctacacaggagacagacaattataatacaatatggtgaaatatgtgctttagagcattatgtacaaaatgtactaagattatagaaaaagcagtagttttgcctaaaggagatatggaagattgcttgcaggaggtaatacatttggtgcttaaaggatgagcaggagtttttatagctgtattaaattaggaagaaacacaaagaacatattttcagagagagctgagcactttgaatttctgaagcatgcacagggactgtgcgaggggatactctgcataatggcgaccatgtagtctgggaccagatttttatggccgtatcaatcaacttaaggagtttgaactttagtccttggatactggagagttaatagagaactcaagaagggtggaaggggacatgggattgaatagatctgcattttagaagctcattcacattctctaaaatttcattactggtatcattttggaaaaataattcaaaaagtgagaagggaaatttatgttgagtccatatcactcagactaggtagtaggatggctataatcacgtttggtatgtttaaatacttagcttggttcgaaatgtatatagacttcctaatatttacggttgctagatttggtaaataaaaacagagagtgtccatgcaaatatttgagacatatttataagaaaatctttgtttatctgaaattcaaatttacctgggcacatttatctagaaaccctacctgaattgtcaattggatgtgatttctccctattttttcttccctttcctatgagcattttaattttcagcatatggtcatgctttacattttgtatattcagcaaaccctaacaaaaactacctacagtggaaaatcattatggaccaagaatcttccttaggcttttgctgaaattaaaatttgttgcttgcattctgtttataattttacagtttacctctacataaggtttaataatacaagtatagccaaacagcactacaggatggcagttaatggataacaattagcacatccttccacttgtagattacttattatgtaccaaacactgttctaagccttttatatgtattaacacagtctacaagctaaatgttattattattatgcctgttttacagatgaggaaatcaataaactgaaagtgtaaataagttgcccagagtcacacaggtggccaaactgagattaaagcccagataatttaatttgtctccagaatctatgctaatcacccatatgtttcaccatcactagggaatattagtactcccacttcatcacctcttcttaccagccttcaaggtattattttatgtgctaagaaggacagatataggataacacatagtccttgttctcaaaacgttgataataacctaatattggcatttctcctctaggttaaagactccagtcctaaaatgttagtttggaatacacttttccccaatccctttattcgtcttagtaatttcctcaaaatcctaagtggcttgggtttaatgggcatttgttccctttttattcctgaaatccacaaccacttgcttatgtaaaaatgaatttccttgcctcctacagtcttttatacatatcttttaactttacactcagatgaaaggagttacatttgttacacaatttcctttttagagggcattgatatatttcatacctatagaattaaaattttgtcattttttttctcggtcacaattcaccttatgtaaaaatgtttgaaaaatagcatatatacttaaaaggacacaaaacagtaaagttacaagaattattataaagagacaacccatataacaaccaccaagggcaaacaccagaatcctgccagcagtccaaagccttcatgtgccacattcattcaaaccctcccctacacccacataaaggtgacagatcccctgcttggtatggaagtcacagacttgctctttgtatagtttataatttcgtctcctaaatatttattcccaaagagtttatttttgcctgtatctaaactttatagtaaaaaaaaaaattctgtatgtgatcttctgtttgtggcatctttcaaaatgttgcaggtgactgcagtgagttcattttcactgcagagtagagaaattgctctagagtattttaccataaaatgtaccatatgcttttttctttctatggctaatggcattagtagtggtgttggaaataaaagcatcagggaacatgcatgtacatatctcttgacaaacaagtatgttgaatttttttttctgggtacacttaggagtgaaatggaggagtcataataatgcatatatttaactttaatagataatacccaactgattttaaggtggttatgccaatttgcactcttatcaccaattaataccacttttgaagatacaaactatatgaaacttgcaggtaaccactatttcactttatgtggaagtggagagtggaaaggcttaacaccaataaatctttttaagatacgtttttaccaagtggggcttttaagggaatgaaataaaaccttcagttcaccaagttcaattacattttttttcttcaatgaccttaacttaaaaaaaaaaacacctcacactaaaaatgcctaaccactgaaagcttgtaagtaatgttacatttcaataacaggcactgatacacagttaaattttgttatacagaaagataattttgcctaacccttgaattaatttcttaaaaggaacctaataaatcaactattatacacagatacatgtagactcagataataaaattaagaatacttcctgcttctatattctgatatctttgaaattttatattatgggcataattaaacaaaaatgatgtcctaaatgagatttctaaattatcttatacttctaaagctattgtaaggattatattatacttctaaagctactgtaaggattcaatgaggtaaattatgagaaaaatatcttgtaaactttaaagactgcaaatataactgtccttattattatatgagttaaaccatattcatattgtttgatagagtgtttcttggttatggccatggaggaaaatataggtgaatttctgatgaggctttctgtacacacatacttctacatttgggtttatcatcagagtaaataaatgggtagaatttttataaatattctacagaagagtagccctgtcttggagaggaatgaaaggcagcatttatccaaaaaattgcaaagcatgtggaaactttaatacactgaatgggataattcaacaaatactcttaatatacttctttccaaaatggtgacatttactattttttaaactaacacaccaactctttatcaattttggctgatagatcactgacatctgtagcttaaagacttaaattggggttggtaaatacagaaaagactccttttttaaattcttaggagtttcagtcctcatcaaggtgaaagagctgggtggctagatttccctcattccagaatctcatctacaaaattataggatattttgtgggttcctggcagagctagaggcaacaaaacatctgttacactcaaggccaccatggaagaatctgcttcaagcaacaaactcactactcagtgctaaaaatgctgtctccaagccattactttttatatatttttatcccatatttattggtaagtatgccaaatcagcatattttcttcattaaaagtgataattttgggattcatgagaactctgcttctggcctagacatagtaaaagggaccagaattttcaggcagaccctcttgttttaaaaaacaacaaaaacgacaaaaaaaaaaaaaaaaaaacctcagacaaaatacgtgagacaacagtgttgaacatactgaacattaagacacaaaggactctccctcttgggccatggcatagggagggagaatccaggcagagcctggtgaactctagtgaaagagagggagctgggagtctggagagtcgacggaggctagtgtttgtagaacagaatatacccaacaggagagaactacacagagacagttcaccacagagatctgcagtcctgaacactgccgtgctctctaaagtactcagcagagggtagattagcattcacaggggagcaaactcctggggaaagagtcatctgaatagaccagagggagcaatacttggagcccacactaggccaagagaactgccaattcccaccactaagactggaaagcaaactgtttcatggggcattgggcagaggacccagaatggttttgtcttagtagtgggggataattaaacctggattaaataaattattggtcccacctaacgaatcttataagcaagacctagaaggatcaaactgtttccaaataacctaactatataagaaaactaagctcaagagaatatataggactacaaagtactgagcactcagcaagataaaattcatgtctggaatccaatcaagattaacactcaagaaacaaaaaagatatagttgaaaagacagtatatattaaaattagcagagaagtaattaaaacagttattaaaactgtattccatatattgaaaatattaaatagagatgtgaaaaaagaaagcctaattgaacttccagagatgaaactaacaatgtgtgagatgaaaaatatgccagaaaggaataatagcaaattagacatgcaaaaataaaaaaaaattttagacgttttaagacataccaattgaaaatatacaaaataaaatatacagaaaaaaatctgggcatcagtgatcagtggaacacatatagttagtctaaaatagatgtgattggagtccttgaaaatggaaagtataaaatatttgaatagattatagcccaaattttccaaatatgatgaaaactatactcacagatctaagcagctcaataaatcccaagagtaagaaacacgaagaaagctacaaaaaggcacatcgttattacaaaagacatcaaaattattctgtagataaatgtagtcttttcaaaaaatgatgctgaaataattgaatatatgtaaaatacacttagaactacataagaaatcactcaaaatagattgtagattacaaagtgaaacttaaaactattttttctatatcaaatccataaactcctgctccccaatgtcaattttaagagaattaaaagacaaaccacagattgggagaacatatttgcaaatcaaaaatatgataaagaacttgtatatacaacatataaacaactctcataactcaacaagaaatcaaataattcaataaaaagtgggaaaaatatttgaactgacagttcctaaaagaatatacataagagtggtaaataaacatatacaaagatgttcaacctcatttgtcattagagtatataaattaaaagcagaataagatgtcactacccaacgattacaacagctaaaattaaaaagatggtgttggtgaggatgtggaggaattgaactctcatacactgctgttctgatataaaataatgcaatccatttggaaaaccatgtgacagtttttcaaatacttaaacacatgtctaccatatgattcagccattctactcctacatatttatccaagacaaatgagagtgtatgtccacacaaagacttgtatggatgttcatagcagctttattactatagtaataaccccaaacctgagacaacctgatctcaaaatagttatgctgagtgaaataaatcaggcaaaaataatatacagtgtctattttatttatacaaatttctagaaatgcaactaatctatcatcacagaaagtaaatcagtgattgggatgaagttgaaggggcaggaaggagggattacagtggggaagaaacttctgagggtgatgtgatgcaaatgtttagtatcttgagtaagatgatggattcacaggttcatatatgtgtcaaaacatatcatattgtacattttaaatttgtgtattttattctgcgctaattatactccaataaaaccttcaaaaagtgatttttataatccacatattttttgtctgtaaactaagaactgcatacacacacacgcacatacacacacacacacacacacacacacacacaccccgacactccatgacaataaaaggcccacagaactaatgaggaacattagccttctcaaattcacaaaagaaaggtttttgtacaatatacttttatttcaatgtgagaaccatgcagtccaaatgaaaagaggcaggtcttatgggagagactgagtagtttaataaaacatagtaataggaggagctgtattcataaagatgagaaaaatactgatttttaaggtagtttacttcctactttgcaggttgtttccaccactcaagaaagtctttgcaagaagctttaaataaagatgaatggggaaaaattaatgtaactggaaaaaattagtatcattgcaagattttctattgctcttatatttttggtttcaggttgaatttgtttttgttatcattgactatcagaaatctgaagcatataaaactataacgggggttagctataccttccctaactgttcttttccagaaaaattttctgatggaagttcatgaagtacattgatgtgtatgttttctgtactcctatgatctattcaagagattgtaattttcatacaggaactatgaaataataataattttctagttctctttgctgcttcttttttttttttttcttttttttgagatggactctagatctgtagcccacgcaggagagcagtggcacgatctaggctcactgcaacctccgcctcctgggtcccggttcaagcaattctcctgcctcagcctccagagtagctgggattacaagcatgagccaccatgcccagctaatttttgtattcttagtagaggcggggtttcaccatgttggccaggctggtcttaaactcttgacctcgtgatccacccgcctcagcctcttaaagtgctgggattacaggcgtgagccactgctcccagccctctctttgcttctgtgaaggatataactttaaaaacttataaaaatgtatgtttaaaggagattttcattattaatttcttttaatatacattaagatggaaatttcaattccattaattacatactgcataattttacattgaaaaaggaagccttcaagacaacaatttccatggtatccaatgaacctgattaaaataatgggctatctccataacaagtgcttagataaatggtcctattctgtcagagaggaatgggtcttattagaaactgcattgctctgttatgctattataagattaatgcagaaaaaatgtttagttccttttaataaaatccaatgacttgtgaactggactaaatgtcagtaaatagtaagtgtaacatcgtctgcttaatttggttgtttaatttggcccttagtataaagatttgagtttatgcagcatcttacttccctacactcattaaatctccttctgccatgtttcagagaataaaggagggcttatgtagttctgattaaataagctacagagttatctttagaggtgatattaatatcttcccaaactataatccatccttgaggtactgcaatattttaaatatttttgtaaagacatgcagaggtagaaaaaagactaagatatattgatgaatttattttattgaatataaaaatacatatttttgaaatctttagaacactatagatactaatatactatactaaattcatatgttatgaaaatacagaggttactgtaattttgtacagataagcacaactggaaccttattattatctatcagccatatatttctgtgagtgtacaattatttagcccatggcttttattttattctgttcattaccaatagctaacatttctcattatacaaacgggaaaataacccctcaaaactacctcttactttatactccctatagaattttgttaaataatgtatttaaacctactacttgttcatcagttttagccattaaggctgctacaacacccttcatatctctttcttggctttaaagtcctattgttattattcttttattattattatttttttgagatggagtctcatgctgtcacccaggctggagtgcagtggcacgacctcggctcattgcaacctccgcctcccaggttcaagcaattctcctgtctcctcctgagtagctgggactacaggcacctccccaccacgcccggctaatttttgtatttttaatagagacggggtttcaccatattggtcaggctggtcttgaactcctgacctcaggctggtctcgaactcctgacctcccaggttcaagcaattctcctgtctcagcctcctgagtagctgggactacaggcatctgccaccatgcccagctaatttttgtatttttagtagagatgggatttcaccatattggtcaggctggtctcgagctcctgacctcaggaggtccacccacctcggcctcccaaagtgctgcgattacaggagtgagccaccgcacccggccttgttattatttttaacatcagaatttgatttacattttacaacatattctgttctgtagtcatgttccagtgaactacagctacagttaattgatataacaatcacaaaacctccatggcatacgatactcatgtatttatttctcagacatctgagtgttgctggggagtggtgtcaagagatctagagtgggctacactaagctctactttgagataaaggtctgctgggcttggttccttgctgaggtttgggctgaagtcagctccctgtgtgatcattcagagatccaagctgagggtacaacagctatcttttgctcctttgctgtgatgatggaagaagttccgaaaagaaaatgaaacatgcaaagcctaggctcataagaaacttattgtcatttcgtgtcaatggccaaaccaagccatatctccaaacccaaagttaaggggtgagaaaaatatatttctccttataggaggatttaaatgtcataaaacaagagtaagaatatagggaggggcaaagaattggggcaataatgaccattttacattaattcctcaatatcttgtctataattggttgtaaaaagtggaacaatgagaatacttaccatacaataattatatgttaattattgtagaatcaagtaaaaaaaagtcactgcacttcactaaaaatgtgccactttatggaggctgttctagcattacagtcaaatggacttccttctgatgcattctaccaattgtttaaaatcacgacacatttaatgcttcatatttatagtttttttttctggaatatttaatttttttttttgcttgttaggagaagtataaacttattcaccatgtcagtatttttattgaaatgtacttccatacttcttgaagaggcctcctggagccctcttctgcttctgctttttttttttttttttttttttaaagacagagtctccctctgttgcccaggctgaagtgctgtggccggatctcggctcaccgcaacctctgcctcccaggttcaagcgattctcctgcctcagcctcccaagtagctgggattacaagcgcccgccaccacgcccagctaattttcgtatttttagaagagacggagtttcaccatgttgaccaggctggtcttgaactcctgacttcaggcaatcctcctgcctcggcgtcccaaagtgctgggattacaggcatgagccacgcgcctagcctctgcttcttattctaagtttagctgattcctttctaggtctgctgcaagctccatcctgggatatcttctccttgctcacctgggcttattctaccctttcttggatcctaggtttctattttttgtgtcctcttttcatttgcaataaaacatctttaggtaattttcatgaaaggagtaagtataacattattttgagccttaaaattgtcccaacacttgaataacatttggctagtcatagaagtctaagttcaaattcatatatccccagaaagttaaaggtacattaattttttcatcgtcttttaatatatggttgctgccagagacatttgaagccaatataatttttgctacttttgagttaacctgttacatctcttaggggatttggcattttttctatatccagattttattagactgtctagaattgtttttcattcattgtgttggtatgcattaattttttcaacatgaaggctcattcataacattggagtattccaacgtaacgttattcgttactccattcctgtgttttctctggaattagtcccgtgctgaatatcttaaatccattctccatgttcgttaagcatatatcttctattttttattttatctaagttttggaatatttctatgacttcaacctctcactacactttttaaaaataagttctccaatcatatcttttataaccatcaactctttttcaaggtgacatatagtattcttgttttatgtatatcatattttctttatgatcctaattaagatgtttaaaaaggtccctctgttccatgaatcatactttcttcctcttgcatcatttatttatgtgttcattttggatcttctgttttgtgcagtttacttcaaatgtctggtgaaccttgattgcctacttacacgaatgaaagactagattgacttgtatacttaactgtatacaagtgtagtttattcagtactttaatagttttatttttgaacaagcttctgtcctgtacggaggactgactgtatcctctagagggggagcataggctgggagaaagtagcaaggctatcctcatcttgcaaaataaggttttattcagtgttgtcaatttctgccttaggaacccaagttttcccctagtaaactctgaaattttggagacagtagtcttctaggtttagccttggaaatcatgctttatatgaaggaggaatagggaagggaagaggagggcaaccaggacagctgttccagagttcttaattaatttacctgctgtctgtctactctgttctctgtaccagctcacccctagctagcctggaccctttccactaggcagagaatagcttctacttccatttcagacttttccagatcagggatgtaggctcaaggactccttctttatcaacacaattccctcctgtatgctgtcatctagaaatgccaaaattcactggggtgctaatagtccctctcgctacttttagtctattacaaacttattctttaattttaaaaattcatttaatcttcactgtcacttcaatgtggtttgagaataaggggatgctaaatatgtatgctcagtttgctatcttaaaaggctaagtttaaatgttgctaatgaagaggcttttttagcactttgaaaacaacctcttatcactatcactatctcttggcttagatacagctctctagggagggtggcagcccccaaaataaaatcatttcttctgactgcgcagtcaaattacagaagagtatattccctaagagagcaataatcttggtcccagagtttgttcaggaaagcctcaggagaagtaattcttttttaaaaatttagcatccaccagaaataaatctttcttcaacatatattcatttgagacactagaccagagtactatcagcacgtcatagacaccgaaagagaaaaagagaagttaaacacagttgagtttcttccttctctagtaatgtctttatccattttttcatgccagaaattaaccatgatccataatttctttcaaaaggtcttagaaaaaaacatagcagatcaataataaagctctaaggatgtttttttaccatttttttctattaaaaatgtcaagagtaattgataagaatctctatacaaccttttggttttctctttaaaaagaagtgggatcaggaaaagtaactaatgggtacgaggcttaataccagggtgatgaaataatctgtacaacaaacccccaagacacgtttacctatataacaaacctgcacatgtacccctgaacttaaaattaaaaaaatgggggatttactcaatcattgactctgaaacagttttgtacatattccagatgtgaagtaagcaatccagtaaataatatttaagctagtataaagaatcaatataaagaggttggggaccatggtgtaattgaaaaatttacttttttcaattaaaaatatgtatgtatgtatgtatttgcctatggatgtaatgtatacatagtttctgacattattatctcattctgcatagtcaacataacttataaaatgataaagtctggttctatgttttctcaaaatcaatttcttggaccatttccatttgcccacataaaataactctgttcctaacagtgttaaagctaccattctgtgtcacctttgtatgtaagaagcctgtggagagaatgatacaaaagaagaagatttttaatctctctaaattcttgttggtaaatttgcttttcccttttaattacttcttgtagagatgtagtatgaattaaaaaaataacgtaacgctaaatgtagaatttactaaatgcataaatatttggaagaaagaaaataaaacacaacttcagcattagaatactgcctatttgggtgccaatcgaaggagatttttctgaaattttctagacaatgataaccggaatctattacagaacaaagaagtgttgctataacaaagcagcatgctgcatataattaaagcattaaaatagcatacagacaaaacaggcacaacaagttttgttatatatgaggaaagattctttaaaaattgtaaaaccagatgtgccaaatgactgaaagtaaaaataacttgacatctgactggtttataaatccatcaattatattggatagagttaagtaatattttggcattttcactttgttacctttattcagcaattcacaaaaatgggtaaccttaagggtcttaccaatttacctcttagctctgaaagtgaatactgctcagatattttaaagaatggtatctgcactgaaggaaattaaagtaaatactgagaaaataatttatccaattcccactagcaatacacacacaaattcagctgcattcctacatatctaaatatgtcagctttttctcagagacatgccctgaattatcctacaaaatagaatacatcaaagatgaaagagcattcagaacatcagcacagaaatacatcgatttctaaaacataattttaaagtgcttccagcatatacaagatacattcatattcctcagttgtgtagtgcctagtactaccttattataaagtaagctttgcatctatttactacttatccctcaattacatggtaaaattggatagttaaaaatagaagaacacataaatatagaaatcattggctttatgtctggaaacctttatcctaagatgtttagaaatacgcttacttaaaaaacaaaacctgtatttgtgataagttctcttaattttggtaatggggtgtttaacttctaaaacctgaggttaagaaattaaattctgtcatttcatgttttggtgttgcagttccattctcggcataagggatattgatctaataatcatactctactcctccaaatatctagtcattttatgtccccacaaactcatttattataaaacccataaaactattccctgtggtgcctataacaaaggaacaaactgaacaataaaaaggaacaatgtacatttttattatgttttaacgatatccccattgccagtacatacacaaccaagtggaaacgttttagccactggcatttccagagatccactttttgccactctgcaatacaaattcacgggtgaaaacatccattaacagaaaagttaaaaggcaatatctatctattataaataaacagtacatttatgagttaatccatcttaggtcactacatgaaagccaggcacagtcattgttacaggtatttctcttcctgctgcataaaattctgattgaaattttatcgtgtttcaaaaatcatacgtagaccaagtgtgtaggtagaaaatggtgtctttaaattagctagaatcagaaaatatgatttatataaatgtaataaaactcatttattggttactcttataagttcaagcttacctgaccccatatattgttaagtatatttttttcattcaacaaatacacattctagtcctttctagccatagtctcaaaacacttgatcatatatcccagtagtaaaattttaactgtggcacacactttcaataaatatatacttaagaatttataaattatatacaataattaacaaatgaataattatgttcataataaactgtatataggaaacataaattttaaaataatgagatatggttacaataaacatttttaaagcatgttcccaattgcaatggcttcatgttatcattaactaatacctaaaagcataaaacacagtattccctctgggttagtttatcaacaataatggtggacgtaaacacatattatagatcatgttgataatttcaactttgggatccaatctcttgttacatataattactttggcactgctttatctcataatattttgtatttagttcataatagaataaatgctagctattttctcaccgcttgtgttgttggcattttcttcattctgacatttctctgcagatttcttttcaggccaattgtggatttggttagaattaatttaatagataacataatagtcacattgtgataaaagggttctgctttgtagaactactactccttcttcagaacctttgtactggtttttttgacagacaactccagtgaggtgcctctgtcaatacatgaggtaaactgcaatgcacttaatacatgtacttgttaacaataaataaacatacaagcaagttatcttattttctttccacttctcaggggattatctcttgaacttttctggggtgtatacatcacaacatggaaacaactactctataagtagtgtctaggaagatgaatctggggatttaaaatataacctatttgtttttaagcataaaaccatgttcaactatttataactcctagagaataatgaatggttgatagaacttgatttttcttattttaatactttattttattttattgctggaatattaacgacattaaaacatgaattttgtgttttattttttgctacattccctcttccagaacagtgcctgacaaacagcagctgcacgtgaagcagtttttaaatgaatcaaagcttattcagctgcaggtaatggttctttccattgctcccagttattcccagtttacccagcactttccaacatcctctccacagtcctgagaggtgtcattttcattttcttcttttttttcttttcttttctttcctttcctttcctttcctttcctttcctttcctttcctttcctttcctttcctttcctttcctttcctttccctttccttttcctttccttttcctttcctttcttttcttttctttcaatagttttggggaaaccaatggttttggttacatggataagttctttagtggtgatttctgagatttggtgcacccatcactgcatggtgtacagtacccattatgtagtcttttgtccctcactccccacccttcttcacaagcccctatggttcattatatcattcttaagcttttgtgtcctcacagcttagctcccacttacaaatgagaacatacaatagttggttttccattcctgagtttctacacttagaataatggtctctaataccatccaggctgttgtgaatgccatgactttgttccttttttatgtctgagtagtattccatggtgtgtatataccacattttctttatctactcattgattgataggtgttaaatagataaactgttcccaacataaagaaggaaaaaaatatattcctttgactagcttcaagacgaatgcctttttaaaacctgggtttgttatgactaatgcttaactcgggtctagttatctggacaaataataagattacaggacaactgtaagataaagattcaccccaaccaaagaatgagcactggggtttctcattaaaaaaagagcttcacagtctataatatttcaaacaaaacaaaagcatcctttacctaatactagatatttgtttctacctgatcctgaatcaaatcttgaggaagctgccattgtttttctgattatttctaggtaataaaaatgccctaagcttacttttagctactagacaatcgcctgtaccttccttactaaaataagtctagttttgtagcatctaaaaattcatagtgatatccaagttggaactcctcattcccagcttaggcctacctgggaaaattgcagtggagaagtgggacctcacctaaaattcacagtctgggtcacaatggaaactctcttatgggtctaaatcattaaaagttatcataaggctaataaattatttaaaacatttgtcacctatctttctaacaatgtggaagactaggttggaatttagaactctaaatttagaactaggttggaatttagaatttagaattgaggaccataagagaaacagctttcaacccactcttctctacagatatccaagcccaagcacctgatcactgtctttcccaagcagtaatcagatattccatggcatgtcactgatcccaggtgtgtgcccactagtgacacagtgacacatgggaggacagatatggagaaggggctcacatggggcctagaagtatgctgggtaccatttgggcagaccattctgggttctggattatcttcagcatggtctagaaaggggaataagtctccaggtgggcatgttcccttgtacccatggatgtcttgctccatagagaggagtggttccagaagaaagccagagcaagatctccaatgtgagatccaggacaaggggtccctcctggcagtgtctaaggaaggaactgggaagtgagttaaggcgatattctcttctctcattccaccttatcctccattctctagtttcttttgacatcttcagtaccaaagtggatgagatgaaatccttgatggtcaggttgaaacatggctttggtgatctggatttggcagatgtgctttgtgggctctttttttcctgggacaatggaaggttctgtgatgacatttcatcactgggaattctttacctctagctgccttcttttatgggcctttatgctctgtgccctggatccccttggagcaccatgttgattgcacagggaccttctctggattttcctcttgggctcccaagataacagagcttcttggttttgagaagtccacatctggcccacaggaaatccacacatattctttccctgccatattctagaactgtactccattccccatacctttctctgtccttgatctgtatccagtgaggacagcttaggccatagccccttgtctttgggcctcccaagaaaggcactgaagcagcagtccatatgtaactgattatatgacatcatcataataaaaggaaaagcttagtgttttatttctttctgaccttcccacagtccttttcttcctttttcagtaataacatacttaatatcaatcatatttttaaaagtaaatatttagggaaaacagacagtgggcttttaaatcgaccaagactcttgagctttgtatttgagaaagctttaaaaataaaagttgggcaagaaatttgaacctcaaagagtgactctacttttagatgacaaacccaaatcatgtttaaagtccctgaaaaacagaaaatgaccaggaagttcattttaaatatactctctaaaccatttgagaattgcaggccataaactatggcagaaagatagctggcaataaatttttcctcaatttggttgctctgaagaggaaagagaaagactatgttctcagacaaaaatgtcacttacattcctatgagactataccttaaagagaaactgaaatacgttatattcctatgagtttaaaatatcaattaaaaaataaagctcactaagaattaagttactttaaggaaataaggtaatttcatgtttatttactttttaacatataagaccatcaatgcaaaaatacactaaatatcttggatgactttattaataaaaaagtcatggatagctcagaaattcatctaatcaaacttaaaagactaatcagtgcaacttaagatcaaaatcagccatgctaggtcaatctatctacgtaacttagaataatgttagtagtaaggtattaacatggacattgtgacatcttttatagacagaaaaatgcataaggaaagttttagcaaaacaaaacaaaacacatgtataaacttgcagtttaattcatcttaaatgaagatactgagaatgattatccatactagaaaatgctatccattttcatcaaaatactatcctgtcatcaaaagtatgatgtcatcaaattctaccttataaacttctaaacggattccattgctttactgtatttaaatatggtgaatcatttatactaatacatagctctttagaagcttgtaataattgactgcttttaagaaggccaacttagacctctgaagctggccataagggactactgctgtatatgctgtgctatgattttctcatcatatatgcagatacaactgagagggatctgaaaaaatattttttttaatatatgccctgctttttccacaaatcagttaaaacggtttgcagtaaaatccctacatatgaagagacgtagatataaaaataaaaataggtatcctaaatgattgggaagaataggaacgtagactaggatacttactggatttgaacattaagtttgtctatgtagataaaatagcttttatagttctcattacttgatgacatgggtatcttcatacttcagaaattataaatatgtgcttccttgaatttaaataaaatatatttaaaaatatactggtaaaatatgccagcactaattcattcaataaatatttatagtacagctaccatgtgacaggcacccttgaaagatataagagaaatatccgtatgtaaaatagccatatatccctgccaagtagtggtaaataaccccaactggtcaagttcaaaagacaagataattgcaatgatctctgttgcaattcaccgtggtgttctctagcgttctgctttggtagtcaaaccataaacaagtgtttagtgtgctcttatcactcacttatttataaattcatttacccaatatattttgagtacctactacatgcaaatcacaattctaggttttgatcaggaatcatagatgactcaggcagaaattatctttaagctgcctggagtgaggagaaatatataaataaatacaaaacaagggagaaagaatgaagaagtaagtgtcttacaaggttgaaagcagagggactttcctgcctgaggaagtagaaatcctaggagcgtttttggaggatctgggcctggcattatcgatgagcgataagggcaagggctttccaggcacagaaagaaaatcagcaagggcaggacaatgggaaattaaggatcctgaaggacggatggcaagtggctaactttagagaaccatttgtatgtaaaggggaatatgaaaataaattaaggaagttagatcagggtcagatttttggcaagagaataggttcagattgtgaagctggtgtccctaactgtgcttcttgctattaaaatgtaaataaagcatacagctagactctggtccttaggaactttataatctaatatgtacatggccggacaaatgcaagatcctcacattgaattgttcccatattcctttcttttaccagatgatgtttagagttctataagaaaagaaactacacacctgacacagttcaggaaaggtcacatatttagagccatctcatctacgacaaaaccatcttctacctgtgttttaccttttacttgtgactaccgtttctcaaggcatcatttctcacaacggcaactcttgtgctgcattcctcttctaagtgctgctagctcctgccttccaatattgctcttgaaggattcactgcctaggctgtgagaatgtagcattaaggcatacacaactgggaaatagtagctgacaatggactaaaggtatgagaagcaaagtgactccaacaaaaacagtgtgctcactgtaaacaacaaataatgacaaaacctccagcagcaagagaggcaaatggctctctcgataatcttgatggaaagcactgttcacggctccttcatcttttagacaaaggatggcaccacgtgcaaggtaacattaacataatcactatttgtggggacaattctaagtgctgaataagtgcttgtagacagttatgcatgggtggctgttccttctactgtatatttgtattaaaacatgtatatgtgcaaatgcaacagaaccctgcattaaacttcaattccacccacccttgcctcctacatatttatcaatcatttaacaataaccctttcatcttttcttgcttctgcctcactttgtttccatctgccctctctcctttgcatactaaactctccattttgaaatttccatgccactgtcactcctctgtcttccaagtgattgatttaaacaatcttaaaaagctttaaaaattatctaacaattatttgtttagcaatctttatatactacatggctcctcatattcaccaaaaatctaataaacactgacaatctgacaatctccaaaaggaggagatgaggtaccgtgttcctcaacttatttggccatgggcctcttgttagaggaagtattatttttcttcacattaattttataagctcttaaagacacatactatttaagagtttttgtttgtttgtttgttctcccttgttgttctcccttgttttgtttgtttgtttgtctttttcaaagcccaatatcatgggagatagactgctattagacaatacattaaatgattcattggttaacacaccaaggctcattcattcatttgtttacttaacaaatatttatcaagcacctatgatgagctaggcactttttaggcacagcaaattacagcaaaatgtaaacaaatcaagtccttgctctagaaaagatgcttactctctaaagagaagaaaaatattaaaacataaatataaaatgtggcagatggtgatgagtgctaagaaaataaagatgagtaaaagagaggaacagcaaagagatggtggaggaagatgttaaagaatgctgttgtcttcgggttagttggaggaagccactctggaaaattcttacttgagctaagatctaagaagaaaaggaaagggagcaagaatcatggttatctagcaaagaggaggccaggtaaatgatcacaatgcaaaggccccagactggaagctggactgacacatctgaggtcagcagagaactgtgtggccaaagtagaatcagcaaggtggagtatagttggatataagatcaagagagacgaacaggaacggggcatgccaggttatttttgttcactataaagactttagattctgcttgaagtgaactatgaaaccatgggagattttaaacacagaaatgacttattactacgtatatttgaaggtatcggtctggattttttttgagaataaattgggagcaagtgtagagtcagcaaaatcattaggagcacgtcatagtgcataatgctgccttaggaagaagtgaaggtggtaagaggtgattaaaatctgaatgtgttcttaaactaatctcagagcatgcaggagacattgagtatagataactcttctaaggagtttgattggaaagtgtagaaccagaacaatagcgttcatgagtttgccccttcctttcctcagactcccacacctctcctctctctccccttcttttcctccttctctccctgcttctcacctcacatactgagaaggtgtacactctcaattataagatgttactttttaaattgaggcacctggtgtttcaatcctctctactgcctaatttagcacagataaaatcagtatctatttctgttttattttagtaccgatttcttttactatgatgaaagaataagtattctgaaaaccaataataccaagaatgatagtttatcagcatacagaacatttaattgtacaaaacactatcacatatactaaattgacagggcatcaccaagtgggatctgagaataggcaagtggcccagttatttctattctaaaaccaaggaaaccaagacctgttattatcattacttaaagttgatatgacttgttaagagtatagaaggaatggaagtttaagtcttttctacatttaaattctcagctctttcaacaaccatgctgtcattatccaaataaactgcactcattttatttagaaaaagtcagaaacaattcctttacttatcaaccaaaaaagcattttcagatcaaggagagaataattctcatttggaaatatttcaatttaagatatatcatataaaatgattaaaatctcctgaatatctaagtctgcttatttccaaacgatgcattgccttaaatttctctaaacttctaggctatggcataattgcaaaataaattaaaatgttgagagcaaaatcaatcattctaaaggctgacattagtaaatatccactctatgcaactgtgatttccagatttcctattcaaatgtaaatgatgttctattttttaaaatcattgttgtattttagcatgtaattattagtcttgatttacatacttctgttatgttttctttaaaatatactgcattacactatcatgacacataacacacaatatatctaaagacaaccaattttatgggtcttttaaaaatatcaaaaattaaaaattcaacatcctaaatagcattgaatatatttaagaccttccttgtacctgtacatacctatatatgtatgaacatatacattatttctctttaaatttctagattctatcttaatgatgctgttgaaagatagaaagagtggcaatcacaatgcatacttgaaatcataagaacagtatattacgctgcccacatctatagtaaaaagtgaggtaaaaagagaaataattataatgctactgaaattaacaaaaatatcccataaatatttatgatgctggtcgtaattgacttcaaactatttttcatatacgaacattgttcaactcctcccaagtgttcattactaccttggtccaagccaccatcacctcccaggtggttgcaaggttccacgcttacccccacctgaacctattctttgccatctgccagaatcattctccaaatagaaattagttcatttactcccttgctgtccaccttccaaaagtgtgcttccacaattacaattacacaactacaataaaactaaaagtcctctctatggcttacacgtccttgactattgctcaggtcctctttctgcccactctcttaatcactcaccatgctccagacacatacccatcttaggattcaatacttgctaatccttgtgattcacatacttgaccccctgacttcattcacatctctgcttgttacttggtaggagcaagcttctttggctaagctctaaaacagcactcacgcccctttgttccataatctccattcttacaaaacataacaaaacttgttattatgcattgtggtgctgttatttctgattgaaattttagttgagataattatagattcatatccatttgaaaaactataatacaaagaaataccatatatattttaatcagttatcctcaatggttaacattttacaaactacagtataaaaacagaaccaaaatattgacattactatgatagtccaatcttattcagatttctccagttttacttatattgatatgtgtatgtaattaggctctatagaattttatcacatatgtaggtttctgtatgtgtcatcacagtcaatatacgaaatggttcaaacacaaggacacctcatgttgcccttttataaccacactcacttccctctgtccctaacatctggaaaccactaatctatcctccatttctaaaactttgtcatttcaaaaatgtaattaaatgggtcatctagtatgtattctcttgggattggcttttttttttcactcagcttaatttcctggagatttatctaagttgttgtatgtatcaataggtccttcctttgcattgctgagtagcaattccatggtatgtatgtaccacagtttgtttaaccatttgcctgttgaaggacatctgtgcaattctagatttcaggcattacaaataaagctgctatgagtatccaggtacaggtatttgtgtgaactttaactttttacttatctgggataaatgcccaagagtgtaattgctggactgtatggtaatgcctgtgtcacattttcatcatctttttctccattaatgaagttctatgacagcagagacttggttattttggttcagtgctatattccactatccagattagtgctttgcactgagtagggagttaataatatatttgttgtataagtgagcttcagatcctcatgaaaatttattctcttgtttatagctgcctttacaggagaaatgatattgcaaaatggtttcttgggaaagacagtagagaggagaataagagaggtgtggccatagcatctgtctccaaatagcctgagatatctgaaccctgaatgaaagagaagttaaggaagaaaggctgagcaacggtgttcacaaaaagatttgtaaggttctgggaaaagacacatgtctttccaactcccaagaacatagtaagacccaatgccattaaaacggctaggcttgaccttgaccttagaccatgtgcagtttcagttggctaggtgaccattagcagagaacggagtagtcttcccttatcactatgttcaaggtcagaacaacagcagtggtattctgaaaaatagtaagtaagctctcattaaatatttatcaaatggataaataaataagttatttcctcacatggctggggaagactttaggggagaatgaaatcctacctaagcaacttacttggaagatgataactaagagcaacagtaatttagaaatcagtatcacctttggctacaaggcctaggaaatttgaattacatgcaattttttaaaaactgcatttgtaatactatttctatttctgggaacaatctttataaaattatgaatcggttctattttattttattttaattaattaatttatttatttacagacagagtcttgttttgttgcccgggctggagtgcaggggtgtgatctcggctcactgcaacctccacctcccgggttcaagcaattctcctgcctcagcctccagagtagatgggattacaggtgcccactaccatggctggttaatttttgtattttgaggagagatggagtttcaccatgttggccagtctggtctcgaactcctggcctcaggtgacctgtctgcctcagcctcccaaagtgctgggattatagctgtgagccaccgcacctggctgaatcagttctagaagttcaggcctattaatataaatatactaccttcatgagtataatcttctggcaaaatgcatctaacatttttgttcagagattattgtttttctggcaatcatattaaaaaaataaagaatagaaaagaaaaaaatgttttactgttaatctaaagtagcaattttcaactattttggactttatacatatctgagtatcacaaaaatcacaaactttgtgtctatattggaatagtgtctttgtgcaaatagctattatatatgtctgccatgacagtggtctttgttggtttccagccaaaggagaaaaacaagaaaataaaaatgccttggaactctggctcctatagataggttatgggctaaaagttgttgcagggggtggatccgattaagtgagggtcagattttaagagcagtaagctaatatatttttctgccctgattcttttaatcattttggggttcttgttataagacaatttccattatcgtaaacaaagtttgaattcaataaggttgtgcgattacacattcagtgtgggattataataacctatcccaagcttggtttctctttgactatttctgtgcttagtttctttaaggcattataacccttcacatatggttctagaacactgattttcagtcttagttgtacattagaattatctggggaggttttgaaactcctaatgcctatgccatactccagataaattaagtcagaatctctggggtgagagccaggcattggtattttttataatgccccaggtgactctaatgtgtagccaagattgaaaaccagagttccagacccatttgcatcactttcattggggtccttattaaataatcagacatggctccaaaactattaacttcaaatctctatggattggcaagaggaatctgtatacttatctggaccccacatgattcatatgcacagcaagtgtgagatcccttagtttacagagttaaggtgtctcacactgaccggcaaagccattggaaagcaggaaaatttctcgattctagtctgaaaatcttctagggttggagacaagtccattttggaagtttctttggaggtctttatttcaccaatatttttatatagtttgcaagtgtcagtaataacttcaggtaaaaatttacgcagtttttgaagtgaattcttggcctggcatggtcattcatacctgtaatcccagcatgttgggaggccaaggtgggggaattgcttgagcccaggatctcaagaccagcctgagcaacatgacgaaactctgactatataaaaaatacaaaaattagctcagcatggtggcatgcctatggtcccagctacttgggaggctgaggtgggaagatcatttgagcccaggagatgaaggttgcagtgagccaggattgcacaccactgcactccagactgggtgacagagtgagaccttgtctcaaaaaaacaaaacaacaacaacaacaacaaaaaaataaaaataaaagaaaaagaggaaagaatgaggtgaattctttattagggaatattggttttctagtggaaaagtatactgtacaaccaccagtactgtacaccaggtatttggtagatacacctgatagcaataacttaagcataccctgagaatgactctgcatggcacatgcacccaacaacaatgataagctaagtagaggttgccaggtagagggcattaagtgaaaaacgctatattaactgcatgctttctgcaggcagtggtggctctcctgtccagcctactgccactgggcagctctgtatgtaattcccccttgataaaccctgtctcctttgctggctctgggtctgctcttcagcctctcaaacctagtgccatccctactgaagtaaacagaggtccagcatgacaacaggaggtcagagaaaactccatgagtgcccagaagataggatctgagaaggagaaatctgcgagataaatcctaggctggccatgcatgtctgtgtggggcctggtagctgttatacttgatggatggggcccaccacatgagtatggaggtgccttgaaaacactgagtggtctggaagagttgttgcagggggtggatctgactgagtgagggtcagatgcctgagctgtgggagccacagttggtgggcggcttctgaccctgctccaagcagccatagaggctgagctcatggtgcaagtgagggtctgccagttgcaggacgagctgtgactacaaagaggtgccagacaaaatggagaccctggcttttcaggtagcctgtatgaagagtcaccaactcccctgcacccactggaagcagactcgcacgactgcccccctctcccgccccctggaagacagcagcgcaccacaatatgggacgaccccactgtagaattggtggagctaaaaacaggttaggacagaagggtagagagtcaatcatggggtggcttctccatctgtggaacatgcaggcagaggctattatactctccagacttgagatgagtaaaatggcaaaatggcatccatcacaaaccacccggcctggaagcagcacctctgtggtgccagtaatggagacggggccatccccctcctcagctgggtgagtgttgctgcaagatagccaggccaagtgagggagatgtccccacgtggcctttgtgatgacagactatggagggattgcagggcactcctccgggaattaggagtgaagcatgctatctatgctgagcattgccaaggtcccagcaatgaacttttcttgctggcatgaaagacgccatctaagagtccctgccaaaccaaaggtatggtgcactcgtctgtgcgtggggttgtgagggggtggtggtgcactgctgggatgaaagacaaaggagccaaaggaaaggagacagatgaggggcccatcagggtggcctgctgaagacatggcatggcatgctagcaggaatgcctactgtgagggtggagacaacctgatgctgtcttggtcaggctatggcagaagctcaagccagaacaaagtttcattaaagagcctcaggctcagttcactgcctctcctgcagagagatggcaagggcaggcacttttagacctggatgaaggccaaggcttcaaaattctgatgggagcaatggtggccagggtgtctgaggacagaggccatatgtagaactaactatatattggacaaataagaataggctgtgcttgccctagtggatactagagtggaatacactctcatatatggtaacattcatcagttcaaagggcctataacaacaatagatggttatggaatggagggggtacctattttccattgcattaatgatatgctggtttctaagtctttttccagcctggaggctgcagcccccaccttgttgtcccactaggcaaatggaggatggatggttgatgcagagagggtccaaggttcaagcgttttggtcaggtgcttgggtgtcatctggttagatgttaggcagagaacctcttcactgactgggcgcagactgtggcctctctctagaacaagacggactgttgggtctatggagagctgctgctttccaccatgggcctgccgtggcatgtacaggatcaactcccaagtgcttggaagaacaatctttgcagagtgattgttatttgttttttgttgtagtttttagtgctgctgccacatctggcagcaatgctcctctgcatacctggccctggggaaatcacggaagaatgatacgataaaaatgttagggccattcaaggagattctgagctgaggtgtatggtaaatccacctgatagcaataacgtcttaagctaggtggagactgccaggtggagggtgttaagtgaaaatgctatttaaactgcatgctttctgtaggcggtggcagttctgtccagcccgctgctactggaccacactgtatgtaacctccacttcaataaaccccatgtctcattgcctggttctgggtctctttggcctctcgaaccttgtgccatccccactgacattaatagcaatccaacacaacaaaaagctaaaagaagccatcaagttaaaattataaagagtaacttaaagtaagaattaatgataagaggaattctagaaaagtatggagctacatagtgagccttagcctccccctgccttactacacaaaatgtttcctaaaaaattataattgtttttaaaggaagggaaaaaaataaagacccatagcaatccccattatattttaaagtattagtccattaggcatacctaactttttaaagtttgtaaagtatgtcctgaaacgcctcatctgatcttaacacacatctgtttagagaagcaggacaaaggattgttaatcacagtttttaaagaagtgttatttccacactcaacagtgtcaaggtctcagtgcttgttgaagtgaactgaattactggatgagaaaccttaggcacagatccattaaatgccgaatgacgcttcatcaacttaccaagatagagttgtatcagaaactcaggtccaaccagaattcctcccctcacagcatggttcctccagtatcatttggtgattgaaggtagtggtcattccttaagtcagtaatcctcaagtttggtgtactgaaggatcatatggatgtttttaactaaattcaggctaccaagcaaaaattctgattcaacagggctgaagtggggccagtaatctacatgtttaacaagtgtaacatagaagacaaagcacgtaattgccaaatatgtgattaatgcaattaagaatgatcatgaaaacagcaaatatcattgactaactttgagaaaagtgaaatatggaagttacaaaagtgattcatgaccccaataaatattggttaaatgtaggactgcattaatcactaatatacaattaagaccaaactgacttaaagtagttagaatatacaaagagggaagtttttgattgtttttttctggccaactttctcagtggtaaaaaatatatatatatatataatatatatatatatatatatatatatataatatattgtatgtataatatattgtatatatattatatatattgtataaaatatattatatataaaatatatttccatatatatataatatatatatattagggagccttttatcttgagctaatgtgataacatgggccacttctcctaaactgtcctgtttctttccaggctcagtgggctcccagatcagccctcttttcttgaaaagtaggaaagaagaaaatgtgctcttaaaaggaatcaaaggctctggagctgtgcacaggtagagaagaatgtacagaatgccttctgtgggaagatgggaaggagttctgggagtgaagaaataacctttctctatggcattacatttgttaccaggcaatacataaaatacaattactctagccagtcccaaatgcagctgtcagcacaaaactgcttgcttaaaaatgcttttcaaaagtttgacctgtagacaattttggtgctcaattcattctataatttacacacacagaggtgtgtgtatgtgtgtatatatgtgtgtgtgtgtgtgcctgtgtgtgagcgcatgcgtgtgtttcacattcttctatgatatatatatatataaaatttgataattctataccaaatccaatactaatcattattcttataaagttataacctcatgctactttcattaccataaaaaggacatctaatagctgaaatccaaaacacaacgagtgctggtaaggatgtagaacacagggactctcatgcattgctgctaaggatacaaaacagccatgttggagaccttttgaagcttcttttacaaaactgaatgtacttttaccataagatctagaaattgcactactaggtatttgcccaaatgagctgaaaacttatgtccacacaaaaacctgccatgaatgtctatagcagctttatttataattgcccaaaactagaggcaaccaagatactcttcaaatgccaaatttataaacaaactatggtacatccataaaatggattattactcagaggtaaaagtaaataaactattaagtcctaaaaacacacggaggaaccttaaatacattgataagtgaaaaaaaatcagtcttaaaaggctacatactatgtgatttcaattacatgacattctggaaaaggaaaaactacagagacagtaaaaagatccgtggcaaaggttgagagaagtaggaaaggataaataggtgtacaggggatttttagtttagcgaatctgttctatatgatactgtgacagtacatacatgatattatacatttttcaaatcccacagaactatacaatacaaagagtgaactctaaactacggactttggtaataaggtaacagtattggttcatcaattataacaaatgtatcacagcaatgagatatgttaataagagaaattatgtaggaggagggatatatgggactctgtactttctgcttgattttttggtaaacctaaaactgctgtaaaaattaagtctattaatgataaaaccccaaaaacattttaaaaagcatatggaggtaataatgccgatgctggaaataatttttccaatttgtcacatattgataaaatagttgttaaaatagacctattaactatatatttgtcactcctgtatcatgaaatttaaagttctttaaatgtctagctattttccaaaagacatttagttaacattctgtcatataggacaaaatttaaaagtcccccaatatagctgtctgaaaaattgtttaattttctttttccaaatgaaatgttcacgccatatttgtacaactctcatttttattgattttcagtatagttttgattttcacaaaccttaaatattttgcctatatttattattatgtaactgaacgtgatagttgctaagctatgaaattatcacttttggctattcaaagccttatgtagtatttctcaaatttcagtgtatatgagagtcaactgggaattattttaaaatacagattctgattcagttgatttcaggtgatgcctgtttatctgcatttctaataaacttcctgaagatcctgatgcacgagcacatttgagtagcaaggttctaaatatctaggtcataaaactattaccaccatgaaaaacaaacccagatacctagcaatccttgcaagagtttaaagagctctttttctgtttttcctagctgaagaagcttccagggcccctagcacttctatagctgctttctcaatatatcacccttttcaatttcatctataaagaggacagcttgctaacctttgtacagtgagtaagctatccatttattcataatactcatggcttatatgaaccaaagaccatctatttccagttcaattatccaatttgtacgtctaaaaatcacagagagatcaaatgactgactcagggtcacttatttaataactgtaaaggtcaggtctcaaatctgggtttctgcttccaaatccagtcctttttcctctgttttctgttgcttctaataatgcaatgcagaaaatagggactaggtggtttagacaacaaaatccaagttcccactgcaattcccactgcaattcctaacatgggtttaaaatcttgttgtgggggtggtcagatgtattaaggggaaagatttctttgtgctttgaaatgtcttgaaattcaacaaaattatattaatttataagcttgtctgaatatagtatgaagctatattttatatattgtttgaacagagtatgaagctatagtttgaatatagtatttataagcttgtttgaatatagtatgaagctatgagagaaaagacttggggtggccagtctgtttccctctgggcactgcctctgatgccacatcacagggtaagtaagggtaagtaacatggtcttcatgggattaagtgaacatcaaggctcctgagattctgggctcctatctttatctttccagggctgttttgaagtgtccatgtgtgaaggctgagcagtgatgctagctagcatcagggagacctagccttggcacctctgggcccaacctgagaaaaatcaatagcttttcattgctttgttggtgatctgagcttttagggacaattccaagtagtttagatgcccgttgtacaaagcacacacgcccatgcactacaataggtttctacggaaattctacaaacttctggccatggcatgtctccagaaaagtacaagatgctcccaaagtcacagagcctgaaggcactctgttttttgctggtgcttggatacagctctcgctgacaaatccagctttgccttatcgttcttaataccattgtcttacccatcaatacagtaatcatggcttgcctattccttccccactcttcctactatgtgtcattcccctgtctctgatcaacattctgtccctccttcaagactcagcttgcatgtggcaacctctgtgagaatctccctgacagcttagagttggctgtggcccctctgcttgctgaacacctacagtgctaaggcaccacaccattcctttgacatttatgttcacccctccttctaagaagaaatcatcactagtgggatctactttctttaaccttccaagataaataagaattgggatttaaaaaagaagtgcaggtagcatacttattgagctttcaaagattttcacactaaaaatgccaacatgtaagaaggagaaaactggcttaagggcagggtggcagttttgtgttttgtttttttttttctgggtatcatctctgaacctaatcaccagagtaatttttggaaaacttaaaggatgtggctttaggacaaatatgaaagagacagatatcagtttaatgtaaagtgcatcttttggcaaggatagtggggcaataataaaaagggatgaccagaagactacaaacttcccatgccactgggaggattgaaacacagtctaggagtcctccactgtggacatggtgtattccatgggagagaagcagcattagccaaagccagggctctcttctgctctcagattctatgattctactacaaacaagaatgatgatggcttgtatactttgtaatcaataataataaaagtacaatgactatgaataacttactgtgctgacagtgaatcccattaaatcctcggggacatttacaaacatagcctatgaatgtatcccctcggtatgcttcacttatttcacaggttcctccattatggcatggattaggagtgcagggacctgaaagacagaaaaaaatatttctgcttgatgcatattcttaaaagtagacattaggtcaacattttgcaattaataattttacagaaaaaagtgttctagatattagtggcatagtaaatgtactggttgtatgagctctggagactaatggcctgggtttgaatcttggtttcaccacttcacaggcgtgcagtcttgagagatttacttaccttctccatgcctgtttccttttctgttaaatgtcaatactaaaaaatttgccttaagaggttataatacagatgaaaagagttcatacatataaaatacccagaacagtgtctgtcacatgtaaagtactcaaaaaattattagcattaaattagatattattaaaatttctgaattgtagaataccttctgggtgtttaaaaagtaatattgaatagcaatttctggagttgtattcacaactccacaatttttgtcccctgctggtacaagcagcatatggctgtaaccacataaaccaagtgaattggatagctggctgcaaagcttttatagagtatgagtttatggtggagcatacctctggggaagcacattttctgccaatctaaaacgagcagtccgtcaaaagttgcatacttagagaagaggggctgatggtcatttttaaacttgagaaagtaacagcagattatttagtacctgtggctgctaatgaaagtgtggtgctgctcagagctctcttggagaaaaccagctgccaggagtgtggttagctgacaacattcagctactgaaccacaggatctgctgtggcagcatttattttaaggccaggctccccagccaaaaactaaataccaaaggggcatagagctagctgggccagtcgtgcctgacctgagacttctctaataaacattctgtactctgaggtgccccaatggtgtggctgagatttttcttaaaaccatagcagtttgagactttttctatgccatgttctctccttccttttctcccttcaaagtgacaggctatgtcacggtctgtaggctcatcctatctactcttgctctctctcccctttgtgcatcacagacattccccccaaaaatcttttacacttttaattctatcttacagtcttcttcctgcaggatgttaattgactcaggacagaatccagacttgagattgtgaagaagggaagagtcaagttgaaggaaggaaaagctctccctgggagatgaaaaaagacaaaaacaaaaaactacagttttctctaatttagtctgtactgattttaattggagagagtagaacatatttataaggaaaagaaaagccactgaagaggaagttaagatgtacatattagaaaaggaaagcaagggtaattaaactaagtatctgactgtgtatgaagaggtgattttgagagccctagaggatttgttcagaaaaggagtgagtgtgttcagctgaaacaagaagcaaggtagaagagctggacaaatgaataataataacttgagtcaactgggttggggcaagggtattgaacagagagtgctatagagaatgactcctcctgcatgggtcaaagccactaataaaaacaagagctgaacgaggtggtgcacgcctgtaatcccagcactttcagaggctgaggcgggcagattgcttgagcccaggagttcgagacaagcctgggcaacatggtgaaactccacttctacaaaaaatacacacacacacacacacacacacacacacacacacaaatccaggcatgctggtgtgcacctgtagtcccagctacttaggaggctgaggtgggagaattgcttgagcctaggaggttgaggctgcagtgagttaagatcacaccactgcatgccagcctgtgtgacagaatgagaccctgtctcaaaaaactaaactttaaaaaaaacaaacaaacaaacttgtgaataggaaaaaaaaaatcaccagcatcacttcaagcactgcaatcggacctcaaccatgggtgggaagcacttagaaggtgggcaactttgtcatgcactggggcaagattttatgaatctatttcttcttctgagagctgtatttgaccctccatttttttccatttaaaatgttatgaaattcaacggttgtggagtctaacaaagaaacacatggaacaggaaacaatgtggcaactgtacagttcccggaccttgacttcccgataggactgattttcaaaaagtaaaaaggattcaggggctctgtgattttttttttttgtcagcaccacaccaattaaaaacaatatatttatttaagtagacagttttgtgctgtgaagcacatatcaattaaattatctaacacctgccttcgaggtggtacattgccaatatttgagacaggaaagaaggtgaatgaccaatgactagttatagaacaatttgaaccattttctttcattgctacaaaatgaaaatcatgctgcagaacctatctctccttctcctctctctgtttccacttcctccctcctcacaaattaattaacatttgatagtgccttacaatttataaactcttttcacataaatcatctcatttattctttactataacttaggtcttcgtcattatcattctcttttacagtttttttttaaatactgaaggtcagaaagattatataatatttctcaatcaatatctaccagtgacagattgaggcctcagactaagaatctgggattctaaaacctatacccctcagagcatcaactaactggggaggggagaatgaaatgatagtgatgttagagttttgactcatcaattcacttcaaatgagagtaaaaatgatagattttgaaactaactgataactgacagccaagcacataaccgctaaagaaaaaaatatataaataattacagtcaaaaattatataattttaagcaaataagagtccttggagatcacttaatccaactttccagttttgcaggtgaggaaaaaaaccaaatacgaattcagaaatgttccctagaaacaacttaatatgagaaaaattaggtttaaggacttgttcctaggaggaaaaatagttatttaaaccaaaactggtaagaaattaccgaagagagtggagtaatttatatcacagagaaaataagtcttccatgctccttcacacttacagggttggacgagggaggaatagaaaatgactgaaacagtaagtcctctgcgagttcttgagagcagttaaaacagtgattctgggcaggtgcggtggctcacgcctgtaatcccagcatcttgggaggcagaggtgggtggataacctgaggtcaaggagttcaagacaagcctgaccaacatggtgaaaccccgtctctactaaaaatacaaaattagccgggtgtagtggcgcatggctataatcccagctacttcggaggctgaggcaggagaattgctttaacccgggagatggtggttgcagtgagccaagatcgtgccattgcactccagcctgggctccaagagcaaaactccatctcagaaacaacaacaacaaaacaacaacaacaaaaaacaacaagtgattccaaggaaggaggtaaatggaagtctctctgacaaaaatggggcaaataggaacctggaatctatgatgctatttactcaagcctactatgtctttgtaaaagtgaaacttggctagaaggtgagaagagcaagatgacctaaatggatctgcgaaataaagggaagagctggggaatggatgcagaaaactgagaagcagaaattctaaaaggaaaggcagaaatatagtcttcaaggagagacagaatccaagcaatgtgctcggaggctgtaatatgtgatgaaaagtagctagtaagaaattgtgatgtccaaaattcaggtttaagttgtttgcacagatgctatgtgaattgcttctgctggagcatctagctctataataacagctgctaaacacacaagcctgtgagtggtacttggggaaatcaaggggaaagggctatactattgatgtggcttatcctggcagaaggggaaaagtattgctgcatgtgatgcccaagagattcaagaatccaatgggttcaggaagctgaagatagagtgaacagcggtttcttaagtcccaagcattctggacacttcctgagggcacaggtgaagcctgtccagcaatcttggggcagcctctgggatttctagatgatgtgaattggtacattggagctcattttatttacacgccaaaagacatcatgaccttggctgacatctggattttagaaaaagattatgtgtttcagaggttatggctgctgttatttttcctactccaagaaattcagtgactttcatttaatggatgaggatggagtaaagcaaaagggccaaagattaaacctttctagagtcccttgcatgcatgctagacaatatgagtgtacatattatctttataatgccttgtaagactataatcttgttttagaggcaataaaatgggctcagggaggataagtatcatatccatctgaaaaagcatagattttaacacactctgcctaactataaagtctatgccctttccattaagccacatttcctaccatgttgaaaatctgtgtattcatgttagtcttcacagatgtaaacggaatcagcatgaattcactaagcacattcctataaataatacaggactccaaaatggaaacatttcagaatattttcaggaaatgggtcacagtgtattagatattaggaacagaggtaggctctgtaattataatgtgagactgatgttatgtgccttgtacagactttttttcaagtactcatgacagagtgttgaaatgaatggtttcctattgtttttccctactagaccataaattctgtgtgggaagacttaacgttggcacacagtaggtgtttgatacattttgaataaacaaggatatggcaataatgagttctaaaaattatatttgctgcctacactgtattctaattttaggtttatgacatcattttcttttggattttcactcaataattaagttagatattttctggaacctttctacacctttcaagcttctagtcctttaaatttataattagattccaatgtgttttgtctctaatatggtttaagcttcaaatgtattacactgaattgtaaataacagaccattagaatgtgtacttttgcataatgattacatgtatcttaattctttggcaaatacataatcaagaaaaatgtaacttgtataatctcattaactgtttgagttacttaatttaactacttctatataaataaaaacattcacttcatgtatgagcaagataaaatgatcagaatacaagttagtatataaagataacataataaatgtagtccaaggtctcaacttacaaaagttgcttcctagccaaaagttatgtttgatgctcaattgcaacagtttccagttttattgccccaagtgataataagcaggctattcatatgagaattagaaatcctggaaaagttttgactttgtggttacccccattccatagtcttctctattttgatactgaaaaaaaatattactaaagtaatatgtaaaggtcttgtaacactataagtaataataatcacctagagcatatagtgttgcttatactgggaggataagaaagaaatggacactgcccagtatgttacagaaggtgtttcccccactaatttcaggttaaataacatttattcattaagtactccttatgtgctggtctctgctagtaatttgggataagcactttgtatggtattaaaattgtcagcagctgaaagacaaatctcacatcagaaaaatatccttagttatccagtttgggtatctcattttttaaggtaatttcaatggctctcttttactgtgaatatactatgcttggtattaatacatttctttgttcatataatggttcctggaaatttaattctaggatttcctagtggcaacatattaaaacatgaaaattaagaatcggccatattcttaattttagcagccaaaactatagtacatttgaggcatctcatatagtttctataacataccagcacacacgcacacatacaagcacacatgtatatcactctcacacagctttgaagcagtttaatagcagatcaaagtttgagaacaaatgagtattattcaaccactcagagcttgtaaaacaaaaagatagaagacaagggcaatctcaattgcttgtcacttcaaaagccttgtaaagaagtttgtctttctatgcattagggcatacagaagaagtatacagagtggtgactaggagcttgtgttctgattagtattcataaaattcgaaattatctgattagacaacaatggtaatatcactcttaacaatgaaagcataaatggactttcaagatacaagaggctttagggagttttaaaatcaataatgctgtaatacttttgcaggtaatctttaagtagctcctaacacaatggggacagcatatgatcaatattaatgaacaactgaattcaacagcatgctttccaggcattttttatgcaagctcatataagtatgtcaacaagattaattcctcacaaaagcagtagatctatatggtttgctacttttctgcatctatctcctcacaattccaatagtagagttagagttatttccatatgtgtaatatgattagctgcttacacacttagagactgtgcccgaaatcatgaataacttatagtacacaagcagattattagaaagtgaataggttaacattctcctgtgataatatgtactaggctttggtcaatttttaaaaaatatgcctccaaaacattgccagttagatatcaaaataaatgtacactttatgtagtaaggaaatgccagtaaggcaattgcaacagcatagtttttactagttgtttaccactagaataaaataggaatagctatgaccccaaatttcaccccaaattctggtgttaagaacatatcgaagttatcttcagtgttgcctttacatttaataattttttaacattttggcagttgccattttgagccactgtcactctattttaaaaccagttgtaaagaaagaaattattctgggaacgctcacatgattgacgtttgcaagctattttttaaacactagttgttgcttctcatcctgctctttttccttctcctttgtactcctcctcctttgtaaacgtaaatgtgcaaaattcagccatttgaggataaaaatcgtctatgagtattttgaatatgaagaaagacgtaaactattttatgatactatctcaaacatttcattgtagtggagaatcagtaaatttaatatatttttcattgaacaaaaaagcatttggatagattataaaaatggaaacctgaagatagagatttcccgcccccccttaaaacctgttgataaattttcttctcaagaattaatactagactatctttatatacgtctgtctataagaaggcactgagatgaccagtggagatgctttagaggtctttgtccttgtttacattcccaggctaatgtaaaaatatgccacaaacatggtagtttaaaacaatagaattttattccttcagagttctagaagctagaagtctgaaatcaaggtatcaacagagccagactccctttgaaggctccaggaaaaagtccttccttgcctattccagattctggtggctcctggcattccttggtttatagcagcaaaacacgaatccctgcctgtcttcacaggccttcttctaattgtttctctcctctgcttataagaactcaccataaatctaatacgtcttcatctttagatccttaacaatctttatgcacaaaggccctatgatgggctaaactgtgtccccccgagaacttatatgttgaagccctgatcttcaggacctcggaatgtgactatattcggagataggactttttaaaagagataattaaggttaaatgaggtcatataagtgggccttaatccaattggactggtgtccttataggaatagggcatttgaacacacaaaagagacaccagtgattctgccacacagaggaaaagccaagtgaagccacagcaagaaggcagctatttgtaagccagggagaaaggtctcagaagaaaccaaatctccagagcctccagaaccgtgagaaaacaaatttctgttgtttgatctacccagtctgtggtattttgtaatggaagccctagcaaactaataccctgtttacaaataaggttgtattcagggttcctggtatacctgaattgggggtagggagcactatttcacccgccttatggttcctgtgtagttgttttgttatagtattgcagttgattaagtaaaccagagttttatgtattagaatcggctggcaaagcactcatattatcagtaattaaaatcttagctaaaattaattttacttggttctcgtcacagagtagtggtggataagctttgatggtgctggagatcaggagagcagtctaaatttggggcagtaactaggtagaatccagaattgggtagccaggggacatcaaggagagcctagcactgcatgataggaggacacattaagaaaggaggaagatttcctggggttaatcttcatccacttaaactattgtttagagttgggcttgctgatggcagtagtttttcaggcactcagcaactttctgagaaagtctttatatattaattccacaatgacaggtaatcattgtggcacagtagttgatgtctccttttcttcaataaataaatatcttattaaatattaatatgactttaaagaaaattaataaccaatcacagcaaaagagctatcattttacaaagtgataactattgttacagctacactttgttaagaggcagtctcccatttctttcccccgtacattcatcttgcacactgctgcgaaaacaacctccttaaaccactacttgcataatggaaattctcagctcagaatgttttattactcaaagagaactctatatcaatactctgtagttattctgcatatacattttttatccttcaaaacatgctgtctaattttgggcatcttttagttggccaataatatttgctgactgtgtgatgttatggcttacataaaaatatgtaatgaacatatgacaaaaacaatgttgctgcttggttttctttcaaagactaagaaaactaaagctgacataatatacttaataataataaagctagtatacagaagccttttgtgaattagtgaataccatatgaaattaagttatcatttttgaatttagtaatataaggcctaggtgcaccttgaaatctttggccagtgggataaacatgaacacccctataatctaagagaaacatagatggcaaacctatgggctatgttgataatcaacatatttttatttttcctgatggccttcagaataacaacgatttccatgcaaaatttcttgtaaaaactttagaaaccataaatgtaatccaacataactcataaagcacacatcaaacaattttcctcaagctaagaaaattccttaaaaagtctttctttttagatcagggagctatttccaaacaaaatcctgcaaatcacttttttaagaagtatatctgtcagaactcacaagccattcattacacaatacaattaaagtttgagaatacacatcagcttgcagtgcaaagtcctaagatatcacccaggtttgccattagctaccatagtttgtttcattttctacatatcaattagacagggcataagttaaagacagagcagagaccagtatttctacatatatatatatatatgtgtgtgtgtgtgtgtgtgtgtgtgtgtatatatatatatatatatatatataataaacaaatatctgagcccaagtttcaggggcatcaagcaatctcactatttcacatagtgtctctaagcaactacaaaaattgcatgttcttcatcaatctttctctgacagcgcttcacctttttcaggctcctactcaacttgccacctatactgcatgattagcatctcacttttcattgcttcatcctctaattattccatagatctcttttgtctccctcactgaattataaattagttttgcataggaaccttcactccttatatttttgtaccctcatagtccctaatgaagagctaaatattttgatattgtttcataaatgtgtgatgattgacttaaaattattactaattttagaaatgtcagcatataacccaaactgcaaatcataatctataacagaaaccaaaaatttagagattggatataaatatcagtagccctttttcatttacactagcaggtttcaacaactcaatgttaagctgcagccaagcctaattctctttgttgaatgttgtagcaatctgtaaaatatcagattttggataattttataattataaacaaagtgtgttaaaaataagtatactatttccacaaagctacagttctttctcctataatatagcatagtgatttttgatcttgaaggcagtggcaggaggtggaggaaaggatttctatttttacttttggaatctgtcctccgtgactgccatgttaatcatgaagcagagagattcctgcaggagatgttcctgctgcactcatatgggaatggcacctacctagacttcacagctgagaacattggaagcacagctggacaggcaagttactgtttagattgcctcctcaggtctcacatgtggcttccttgtggcagatttgaggaggcataaaacaaagcaggcgtggattctggccagctggccatctgttccttcacctactgtgataatttggtcttgtagaattctgttaagtgagcattaagtaatgaccatgtcaaacagaacataatgactgcttataatcactggatgaaagcttaagggatgcttgcccaaacacagaaaaggtcaccaaagcaaaccaatattttttttaaaaaaaaggaacagcaaaattgacacaaaacagcaacagttaactttgttttcatttttactttttatcatattgaatccatgtcaaatcacagagggtgaatatggtacaaaggagctaagtaaatacactgaagtttctactgtctcattatgtgtatatcaatttacatagacaaactaaataagaattttaaaactaagaaaatatgtgaggggctttatcacactgaactaaatttaaggcacttagggttatagccattaacttcaagcttttcgaaatagtttcccagaacaacaccaagtagttactcattagtcaaaatactttttctgctgttgtttttaaaaagattaattgaagtattttattctaagaaagcagcttttccttcataaacacttaataattgcaaaatcataagatttttttacccttgaatggatgcttaatgatgcatccaataaactatattattgggatagtgtcctaactgatctcctgctcttacacatcctccatagctacccaccatgcaaacctaatcaaaaagcttctgttagctcctacagcctgttaatccaaagtccataaatttaaactaatcttatgtcttcagtgttacctcccctgttcatgataatgaaccaatatgcttcacttggttaatttaccattctaccacctaaagatcatttgcattcctagaactttgctcaaatgactctgcagccttaaatgccaaatgcctttcttcacctcctcttttcctgatgtccttttccttcctagatagcccaaagtttcatatcaactctcctctattgtttatttttattcccttcacaagtttttctattaccatgttacatactatttccatccattggttcatttgttcacttattgatatagttattcagtttatatttagagcttctattgtgttccacagtgctaagtaccagggttacaaaggtgaacaaaacaggtgcaccttctaatcttgtgaaacgtcagtaaacgagaggactgactccaatcaaataatcacataaagaaatgaaattgtaaagaaatgtgataatcaaataagaaaaagtgaatgtcatgaaggaaaggtctcctgtgccccaataacctattaataagagggtctctgaagaagtgaagcatagactagaagccggaaaccaagtaacagctaaggtaagaaagaaatgagtatttcatttgtaggatgtagaaggagaaggagggcaagaaaaagggcctgtggtaagactagtgtagctagaacaggcacagcaaggataaagaaacagggaccaaaccgggcagccttcaaaggccatgtatttaagaaaaataaaacaaaacaaaacagctttatggacacatgaatacatttagactaaatttcaattttaaagatgatttgtttgctatatggagaatactttgaaaggatctattttcaaagatgaaaatagagcagttaagaatcattgtacttgtccaggcgaagtgtgataggacgcctggattagagtggtgggctggtaggtatggatggaagtggacagattggacagagaagggtcgaagaagactattctgtttctagatttcatgtgtcagtggatgaatattggtgccattcactgaaacagcaacactggaagagggtctagattgaaagagaggatcatgagtaatctttatggatatattattcaaaaagaggtaagaagtaggcagaggagagtgtggcctggagatacttaatgttagtgtttgtggaaatagatggcgattagtgggtaaggatatagttgcctactgaaagtttagaggtaacataaggaaaagaacaaagaatccaggatcaagactcaatttaatagctagatatggtctaggaaaggcaacatacagagaggcaggaaaaacattagtagggatgtggtatcattctggcacattactgctttgtggtattaatgaacaatttaacatgtacacattgcatcatttggaatgatgttatgctcctggaaatgtgagatttccgttttatgtttcttatgtaacacctctctgttttcttgcagaacccaacagatacttgctgaatgaaaatgttcataacttcatgaattgaatatactggcaaagtgttttaggaaaaacacattttaggagaaaatgttctcctttaagtggcattattttataccaaataatattctagttgatctttttgcttatatagggaaccactttcacattttttaaaaaagtaaaaagtcaagttggagaaactgccaatacctattgcttccaaaagaaggcttatttggtctggagaagtaaaagtaaaaacatggagaatgaaatacgtgatatttggccaaaatgaaggaaagacagtaaaagagtacactgagaaattatacatgttttcatatttacctagcatctttttggtcatcttgttttgtttttcatgatctgtcttgctggtggtgctatcaatgttgtgttctcatttttgctgtccttagaagtccatttgcttgactacacatctaaaactgattcctgtaagatcaatctgactagagaagccagtttaaacccttttactcctaggatgagaaaatctcgacaaagatttgcccacagggataaacaatgtgtggaagaaaaaaccaaaaagccatttagaaataacattattacttgtgtaaaaaacttctctgtatgctttctagtagacatgaaaatgtagactcaaatatttgagaagtctgaaaatccacttgagaaatgtgtgtaacaatttattataattgcaaacccaattaaaaatgttgagctattgaacacaattcattttataatccatgaatatattaaatgtatgtagcacagatttatgttactataaaaatctttatttctacttttccagcattatgcatttaaatttgtaaattctatgttacattaatcacatgaatatagatgggcaacttcactacatttcctataaaagaaatcatgcctactgacaattttgtaggaaattttgttaaagattgactgtagctcataaaacagtaaggtttccttcacgaaagttattagacattttagatcccctcagtttgattgaaatgataaaaaaattacactttaatatcactgtctttggacactgacactgtatttaatactatacagaatacggtcacagagtcattaaaagaagtgacaataatccaggtttgactacactgtgatttaatatttacagtgttttcatgatacaagtaaaatatgctgattaaaatgatcacaatgtcaccatctgaatggacaaaaaagctgaggttcacatcttcagtataagacaccttcagttatttctttccactatcttttcttattaccaatacaatttctattatatgaaagcccattagtgtacagagaaataatatgcagtagagaagtcttttgtcaataaatataatatcttaaataattagggaagttactataaatattagagaagttattatgctacttaaatacagtaggtctgaactgtccctctttaagatcggtgttatcaagtgtaaaagattttcagatgaacaaatactttactagaagtgtctgaatgtttgtcttctacctgatcagtacagtaaagtttttaatgtgatttttttgtgtgacctaattgaagtaggtcacaaacaatgaagtaaagggatttaggattgtatattcagtctttaaaaatcagttataaacgtgtacacttggtaatttccaaagaagcagctaaacaatatccttgcctgattgtacaagacattctgatagtttctacagatgtgctgaattctaacaggagattggcaagcagcaaagaatgaccgtgctttgggcttagaaggataaccatattgtggaagattaaatatcttctggatgaagaatgaggcttgcccccatgaccacagtaggaattctattaaacttgatgtaatatttttctagataaaagaattttgaagaagatttatgtcatagaacttgaaggttccaaattctctttgatctatatgctagaggggaacctgggaaatttcaaggagaaacttacctcttttcacaggagctacctaagcccacctctgggctaaaaagtgcagtctttgattcagacacctgtgcttgtcagacccttcaatttttataagagcatgacattcctacctgtgcctatgctatcccttggagcataagggtctatatgcattcaccctgcacctaactcattaagaaatgttgttgcctctaccttcaaaatgctgtatggccataaactcaggaaacacagatgaatatacacaataaatgatttattgatattactttgcaaaaaaaatataaatgatttgggtctccacagtccttgttgctatgatgaacatgtcaatcaggcttctgcattagaaactttgattacagggaactggctgtttcctctccctgagatgctcttcctctaactctcacctctactaaacctttgctcaaaatcactttcacaacaatgattacccagaaaagttctacttaaaattgggaaccacagtccaatcccaatatttctatttctctcttattgtgatcttgttttctcaatggctttaacgccttctaacatagcatgtaatttatttgtcatgttttgtgttgtgtggtgttgtttgtgtttctctcctgtgttgtgttgttattgtccctctcccctgttagaatgtaattgatgtgaggacatagaactttgttttgttcactgatatatctcaagtgcctggtaatgatgcatccaatacatctttgttaattaaatatatctctgctaggaatgaaactttaaacttattcaatatcgatcaaaatctggaattagtcctacattattccagatcagcagttagccatgtacacaggatcatttcaacacataagaaaatgcttttataccactgtattttgtcttatcccattgacctataaaataagactagaaacaataccatgctttttttcctgaggaattaagtgctggctttggatgcacatatactaagattggaatgatacagagaatattagtatggttcctacacaaggaagtaaggaattatgtcaactgggacccaaggatcaggatctctaaatttgaggccaagagtagttttgtttatcatgagcaacaggtcccgcttattctgttagacattatggtcttataacatcatttgaacatcagcacaacattaagtacatgccatgtgtgaggcactgagtataataagcaatatcaacatatttagtcaatggcctctagaatcctatgtgccaagggagattatagacaaataaataggcaacttcaatattatgaaatgagtgtcaatgtatagtgaatacagagagttctgggaggacataagaggaatgcctaatccaatattggaaacttgggtatgacatcctagagtaattaacctcaaagttgaggtttacagaacaaatagaagttggctgtttaggaaggtgagttagaggttttcagacagaagagggaaataacatgtatgacgactcaaagttaagtaaagcagtcaggagatggagaccatctggccaacatagtgaaaccccgtctctactaaaatacaaaaattagcagtgcgtggtggcacgcgcctgtattcccagttacttgggaggcttaggcaggaggattgcttgaacccaagaggcagagtttacagtgagctgagatcatgccactgaactccagtctggtgacagagcgaaactacatctcaaaaaaaaaaaagcaaacaaacaaaaaaaaagttaagcatagctaaatttgtagaactgaaagaaatgcaatataattgcatcatgaagtgcaagaggggaagtggcaggcgagaaagccagaaagatttgcatagcctgattataacaagcctcactaggcagattaagaagttacactttatgataagggtaaggggaggtcatttaagacatttaagcaagaaatggctattgaatacatataaactagaagtgtaggattagctacttgatggaattactggggatagattctatttcctctaaagagtatatgtctgcctcaacagtggaaaggatagtaggaggtagtgtaataggaaatgaggtagaaacattttaaatacaactatggggcacaacatctgagtaggcaatcagaggacttgtagatagtgttaatatttagatagcattgaagactaggaaactctaatggtaccaatctctgcataatgtggcatttcttccactgtgattagcagagaaagaggatgataccattaatgcaaggttagatgttttctagttgtatgtgggtcaaggcaaaaaaaaaaaccatgcaaatgtgtgcaagatagtgcttctgatgatagaattcttggtcttggctagtaagggaagagaggtcagcctttaaggaactgaaagagtaggatttggaagtctgagatccaagacagatgtattttaagaaacttaattaaatctagatctgaaaaaaaagtagtgctgtagtgaagccatatatatgcctatatacattatcttgtgtatatatttataacaagcttaaaaagtcttaaggattaacatactcagctattgttcttgacgtgatcagaatgagtaaagaagaattagcaatgaagtaaaattctcactatgtcatccaaggttatcgatgccttgtttgtctaccacctaaagttgtctcatgacaacaagcaattagcaccatagttctggaaatactgtgttaagaaaaggaagattcctaagaatatgtgcagcatgtcatggaatttgtatattatgaaatggggtctcacatgtcataaaaaaatgtaagcagcagacatttggatctggccagagcaagaatagctgtatgagaatgggaattagtaatgaagatccctagccaaaacttttctggttttattggtcaccaaagacattaaggtttctaaatggaatgagattgcctgggctataagatttccagaataatcaattcctagcttgcttgataggagattaagacctccgtgtaaagaacaaattgcaactttaattgattttgcttctgaaggagactttgttctagtgggtaggtaatgaagttttctagtttattaggatcttttatattttgaaaacagtatgagcccttaagaaagaaatgtacagccaaatcctggttcatctttatcagaagggcctatgctaggactgtgcaaaccttttataccgagacttcaccctaatttcatcttagtttgttgactttcatttgtttttgcctttgtcctattttcctttacagtgacatataaccatcctcccctttactaactacttatggatgcaggatggaaaatatttatactatttttgcatactttgaaggtttaaacatcagcaaagtgaaaacaactgacctcaaaacatgatctaacccaaagtgagcaccttctgggagatggttttctgcttgacaatactttgtaatgaacttcatctcttatactgaggtagatgtcactattaaccaaaagcaggagctctgtaatggaagaattgaattaagatgcagatttctaagcaagaagagaaacatagagaccaggatagagcacagggcttggatggagcataccaacaaagagaaaataatgtgaggggtttaactttgtttcttttaccctggattttaaaaacagtcatattaaggatcaagtttattttttatttgttgtatcattcttatttcttccaggtagtctcaaatctcccgtaaacatttttgcaacacaaagttttcatgtcgtgggattgaagggactttagtggtgggcagtaaaaggaaaaacaggcttccatgtatcacaactcagctgcgtttaaagctccatcagcagtggtatatggaggaaagcaggagccttgcaaatttattctgtaaccaactgcaaagttagcaagggcttatagccaaactgagagcaactaaagcaaatagtatctaatgactgaggaaaagaagcccttcccatgtctatgggttttttaaattttctaataatgtattggtacaagtcccccagaaggctgaaggattaaggaaacccaggtgattgcaatcagaactatgttctgggatttattttcataagtgaatttatttaggatatgagttatagatattgtatgatttatatatgaatttaaagataactctaaaacctttcttaaaaagcagagtattaacaccaacatggcacatgtatacatacataataaacctgcacgttgtgcacatgtaccctaaaacttaaagtataataaaaaagcagagtattaatttattaatctgtctaatgagtttaaattttcttaggggtcaatcatgactatatgtaaagagtttaagcaatgaagcatatttgtttcaataaaccaaacttgacataaaaataattaatattaattattaattgaataaatacagcatgctttatccccagacctaaagtaacaccataagttttgaaacaagaatcataacataccaaaaaaaatttaccatgtcttcttaaattattacatatcttaagtgataatatttgatggggtttcaaatttagcagggaagcattattttatataacacatccaaattattaaacttgttacacaattttgtgatatattacatttgttttaacaaaactaattagtcatataattattctaatagcactgaaactcatttttaaagagacaaatttatattcagtccaaatttggccaatgttagtaacagacagacatgactactatgtagacatcgatagtaagtaaacactttctttggaacgcattggcataatgggaaagaaacggaaagaaatgtctttctggagaaagagtgagaaatcttcaagtctatatgatttacagtgaaatttatcctcacaggaaagcctaagaaaattatttatcaagtaattccatacagataagcatacttattttcatagcaatgtaactaagctaaggtcactcaggcatagagcagggtaaatcagatgttttataatattttaacaggtctttttaaaattaatgatacaatttaatttcttgtatcttaaatctcaaataaataatcgtgaacataaatactaattcacaaatatatgccacttgagtcttttggagaaagcagttaaacaactggcttataatccatttctcttctgttatcaggggtatgatccagggaaagaaagaaaggtaggggtatcaatttcttgtaaacaagctgacaactaaacctgctaccaaatagatgctaggatgagaatccttatctatgaatgttttcagtaggatgcctctagtttaggattgtttctggtaaataaatgtatttacaatctatggatttataaagtatagctccatggaaaatgttatgtaagctatacagctatatgaagacagtttattacctcaatactcccttgtatgcttggtagctcatgtaccatacttagagacttcatctgtttttctgggtcagaaagcatgtgtctaatgcaaagaaggactgggtagttgtcatcaatgtccctaaactgctttgtcttacccagtattagtaaactgatactgggtaagatctcttatttgtgcaaggctgatttgccagtctaatcttttgaattattgcaactctttatagtcctttctataaatgttgtataaactaagagtaaaacttgaaaggttccaaattcccagaagttaaagaatggttaagccatctacaacataactgcgaaatagaatagtatattgccaactatattttgaaaggtgaaataatcagttacatgccaaaatccacatgaaattctattcaatgcaaaaagagagagtgcacttcatgctatgattaagtaacgtggtatgtagacaatgacaggcattagaagaagtacatagattttaaaaatagaattaaaataaaaaattgtgttgtaaagagttttagaaaagggaaggtcaacatacgcaagaaaaacagtgtgctagtctagtcattaagacttcacaaatattccagttcttaaatacacatggtaggactgcacttctccatcccttttcaagttataagtgtctatgtgaatttctttggccaataatgcaagaagtaatatgtgccatttcttacatacattttaagagccagtttgtaatttatcatgttttcttcccactgctttagtgactgtgggagaaactgctgagatgtagccttgtcagcccgagaccctgggtatctacaatgagcagagagcccctactgactcacactggatatatactccaagaacttctggatgagctttctcctgagccataaacaagttcatcttgactgactcagcaagaaaaggttaataggagtgtgatgtattcatttcataacatctttttaaactaaaaagagctaagcaaagtttgtgcaaacaaagaattttagtactataggatatcagtgaggagtacatagcagggagtggacctgataatattgcagacaagaaacaaatgggtgtagaaggtaacgctaaagaaaagagtggaaataaaggtggcttggatgttttatacctggcagataaattgtaatgccatttatttagagagggaatatttgagagcagaggggaaaagttgagaatatttatttttgccctgaggccattagatgtatctagctgatggctgaaaatgaaagtctgaaattcaaaagagaagtcagggatatagagaagacagagaagagaaagcagtctcacacgtactatgaactggtaattcttctaagtcttttaaatataatatctcctataatgattgtaattttaccattccactggaagaaatgaggcactctaagagattaagctacccagatttggcagtactatccataaaggaacaaataaagcctgagagatattatagaggaaacaggcaaggagactggaaagactatattcagggggcaggcaaaagaaacaggacactaaataggaacagacacttttacaaccaagtgacagagaataggtgccactgaggccaacagggaaaatatcaagaagtaatggattgttgttcatgtcgaatgctccagagaaaactaactagatttatcatcttcaaactattgaattttgcttccaaatagataacttgagaggcaaaagctgaaaattacttcgtttttaatatactgatattctgtaggctgtcaaactgaacaaatctcaaagatgaggcattttatgagcactacacctcatgtttgcctaaattaaaataagaattaagtatcattaggaatactttttaaatttcttcagataaaaaaagtctccagcaaagatgacccaactgatgttgaatgaaccccttaacaggactaagtcatacaggtaaattaatcccataaattgctctcaaaaggaatctgaatctcagggctgatgttggtgtgccagcaacacacgttcctgatgggtcataatgtttaatgagatgcatgggaacctctgaattggatgaatattcaagtgatcttcagggaaatcctgaattagaatcagctccaataatttaattgaaaggtcacataactgagtgactattataaaatctataatataatggaagcactgtactcgcacaagtggcagttaagaactttaggtcaagggcttatctcatttttagactcataataagacaatactctttacttttagaaaatgtcaacattcctctaaggaaaaattactatattacttaagagaaaacatttgcactttttctattaactatatccgaagagggtaaggaaggcgtatatcacatctgtagaaacattttttaaaaaaatacttggaatactatatgtttttgccaatccttagaagtgatcaacggttcttgcagatactgattctattattagaaaacagcttttgatttacctgtttgtccaacaggggtctccgcttttgttgttttgtacttgtattacttttattcttaaaaaactagtgaaagcaaaacttcaaatacaacttcacctaagtgaagaatgtttacaacatttaatggtcatttagtgaataaacttaaccaacataataagaattaattcaattttttcattagaaagttgttatcagtttccaagcaaaaactatgcatttatataaccctgttagtcaaatttactttcatatacttcagggaataatgtccactgcataccctcaaaactaacaatataggacacagccaattttaaaattaaaatattttgaacattgtctactctgattataattagcacagatgttatttacttttcctttattctcatcaaatgtagattaaaaataaaactgaatttctgccatcaagataattaacattttataatatagttccatgtcattgatatccaacctgttctttatttaaataaaaatttatttcattttttaaaaattgtattttaaagttttcatgcctatcaaacgcccattcttaggcactatccaattattttccatatctaggtatacatacaacctgcccatcccttctctgcttgagttccaattaactcagaaattcagcaggctccttatgactgcaatgtcagtatccttcaaagtcttctgctccacgttgaagtaacatattagtgatctcaaaatagttcttaaaattttctttctattatgcccctttacaagcataagttaattggcccaaggccaatatttaaaaaaaaaaaaaaaaaaggccacatgacctaaaaacgaaatgctgcttttttataatttttaaatgtaatgtttcctgtaagcagccttgatacgtaaaatagtaacgcttttgtgtgtgtttctgagacagagtcttgctctgttgcccaggctggagtgcagtgacgcaatcacagctcaccatagctttgatctcccgggcacaagcaatcctccagcttcagcctcccatgtagctgggactacaggcacatgccaccatgccctggaagattttttttttttttttgtagagatagggtctcaccttgttgcccaggctagtctcaaaatcctgggcccaactgatcctcccgcctaggcatccaaaagggttgggattacaggtgttagccaccatgccaggctaaaataaatagtaactttctaataacatatatatatatacctatatgtttgtacctatatatgttccacattttttgtgtggattttagacacccctaaaatacattaaataaactagaagcattcaaataacaaataaaaataatgatggacagtcatgtgataagccagaaaaacaatgaagtcagatgtgtcattgtgaaagactctttatctccgtgacagaagtaatatgaaatgtgcaatagccaaaatatttaaaatcatgtaagtgagctgtgtccacttgaaaaacttgactcttttgctgtgaatccatctggtcctggactctttttggttggtaaactattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcacctttatcattttttattgcgtcaatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagctcttgtaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttaggtacccagtagtcattcaggagcaggttgttcagtttccatgtagttgagtggttttgagtgagtttcttaatcctgagttctagtttgagtgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttaaggaggaactggtaccattccttctgaaactattccaatcaatagaaaaagagggaatcctccctaactcattttatgaggccagcatcatcctgataccaaagccaggcagagacacaaacaaaaaagagaattttagaccaatatccttgatgaacattgatgcaaaaatcttcaataaaatactggcaaaccgaatccagcagcacatcaaaaagtttatccaccatgatcaagtgggcttcatccctgggatgcaagactggttcaatatacacaaatcaataaatgtaatccagcatataaacagaaccaaagacaaaaaccacatgattatctcaatagatgcagaaaaggcctttgacaaaattcaataactcttcacgctaaaaactctcaataaattaggtattgatgggacatatctcaaataataagagctatctatgacaaacccacagtcaatatcatactgaatgggcaaaaactggaagccttccctttgaaaactggcacaagacagggatgccctctctcaccactcctattcaacatagtgttggaagttctggccagggcaattaggcaggagaaggaaataaagtgtattcaattaggaaaagagggagtcaaattgtccctgtttgcagatgacatgattgtatatccagaaaaccccactgtctcagcccaaaatctccttaagctgagaagcaacttcagcaaagtctcagaatacaaaatcaaagtacaaaaatcacaagcattcttatacaccaataacagacaaacagagagccaaatgatgagtgaactcccattcacaattacttcaaagagaataaaatacttaggaatccaacttacaagggacgtgaaggacctcttcaaggagaactacaaaccactgctcattgaaataaaagaggatacaaacaaatggaagaaaattccatgctcatgggtaggaagaatcaatatcgtgaaaatggtcatactgcccaaggcaatttatagattcaatgccatccccatcaagctaccaatgactttcctcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatctagatcaatggaacagaacagagccctcagaaataatgccgcatatctacaactatctgatctttgacaaacctgaaaaaaacaagcaatggggaaaggattccctatttaataaatggtgctgggaaaactggctagccatatgtagaaagctgaaactggatcccttccttacaccttatacaaaaattaattcaagatggattaaacacttaaacgttagacctaaaaccataaaaacccgagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacagagggctaatatccagaatctacaatgaactcaaacaaatttacaagaagaaaacaaacaaccccatcaaaaagtgggcaaaggacatgaacagacacttctcaaaagaagacatttatgcagccaaaagacacatgaaaaaatgctcatcatccctggccatcagagaaatgcaaatcaaaaccacaatgagataccatctcacaccagttacaatggcgatcattaaaaagtcaggaaacaggccaggcgcggtggctcacgcctgtaatcccagcactttgggaggccgaggcgggtggatcatgaggtcaggagatcgagaccatcctggctaacaaggtgaaaccccgtctctaccaaaaatacaaaaaattagccgggcgcggtggtgggcgcctgtagtcccagctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaaaaaaaaaaaaaagtcaggaaacaacaggtgctagagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatctatgtttattgcggcattattcacaatagcaaagacttggaaccaacgcaaatatccaacaatgatagactggattaagaaaatgtggcacatatacaccttggaatactatgcagccataaaaaatgatgagctcatgtcctttgtagggacatggatgaaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtggggggagaggggagggatagcattaggcgatacacctaatgctaaatgacgagttaatgggtgcagcacaccagcatggcacatgtatacatatgtaactaacctgtacatggtgcacatgtaccctaaaacttaaagtataataataaaaaaaagagttctacaaatgtttaggttgcactactactgtttgaataaagatattgcttgataactaaaaaaagaaagaatgaataaatgtatacttaattatttaataccttccttctccatcccacaagatgtgagctccataatggaagggctgtgtttgccttggtttctgctgtatatcctggttttgtacagtacactatgcctatgtagctgctaaatgaaaaaataaaggattaactaaacttattaaaaaaaaaagaaaaacttgactctttcacgacagatggtgaacagtaaggctattctcaacttatatcaataatggggtagaaaagttggcagtgcggtaacactgagcaacagagacacacgaatttattgagtgtctagttcactggtaaataaaatgaaagaaattctgtaaaaatgttttcttgacatatttttcatagcaatctactggcattttctgttctatccattaagttactaaacatgatgatttcccaggggtcatttctatatcacactgagacacttggctcttgttacctgaatctggaaagagcttagacttgtgtcaaagcacattctaatttaccctttatcactatcctttttaaagaaagttttcaaagtataaaaagtatattcacttaacaacaagttttacaggttaaaattagcattaaaacaaaaatttaaatagtaatagtttaaaagttcatgtgttcaaaacaaaattaaactttggcttccaaattgctaaaatgaatttggacaaagcattgttttaatctactatagtaaatatttgtttttcattcaaaacagataatccaaaacaagtcgattttatcagctaataactgataatactgaaatgaaaataaataaggtttaattttacgttttgcaatgatgtgttactctaactaaactgactggataaaatatgtgtattttagttttttgtaatctcatgctctatatattttattgcttttataaataaataaatctagaattaaagttggacaaactgtataacatcaagtaattataaaactatgttaaaatatttaagaatgaatttgtgaatataacttttgcttctttaaaataaaaaggaatgactttataatatgcttaaaatattgcttatctgtttttctctctccagaattaaaaaaaaacatataagcatatataagtttaaagtaatataaattatagttcctgcctaaatttttacccataactcacttcttagaacacacagagttaccactgaaatcaaagttagttacatgtttactgaactgtattggctgaggttttgaaaatatctacaggctgtatgtatggtatctatcctttttcatcgaatagactatgatttcatcattatattttataaccactttttaatccagaaatgcaaaatatgagagctgcaaaagtaaatattccaccatccttatgaatatttcattacacaatatgtttatttagttacaatttttttggaagagccaaactaattcattgcacatttatttagtacatctactgtcactattgtagtaggttgaatggtgctccgccaccccgccccccaaccaaaatatattcatgtccaaatccctggaacctgtgaatattacattatttgaaaaagtctcattacagatgtacttaatttaaggacttctatggtttagatatggtttattcggccatgccaagtctcatgttaaaattgattcccagtgttgaggtgaggcctggtggaaggtgtctgggatgtggaagcagatccctcatgaacagcttggtgtgcaggagtgagtcctcactattagtatccgggataactggttgttgaaaagagactagcacctcctctctctcttctcctttctcgccctgtaatgtctgctcctctctgcctgtcaccataactggaagcagtctgaggctcttaccagatgcagatgccagcactatgcttcttgtacaacctgcagaactatgagccaaataaacctctttataaattatccagcttcaggtatttctttacagcaacacaaatgaactatggaaaggatcttgagatgggatcatcctagattacccagatgggccctaaatcccataacaagtgtccttctaagaaacaggagaaaagacacagacaaaagcggagcaggtgatgtgaagacggaggcagaaattgcagtgaagtggtcacaagtcaatgaagtcaagggatgcccacagccaacacaaactgaaagagacaaggaaaaattctcttctagaaccctcagagagagcatggcctggattatgccttgacttcagacttctagcctccagaactgtgagaattaaaagagtgttgttttaagccacagaggttgtggaaacttgttagagcagcctcaggaaacgaatatagctgtagacagtcaaagtgattagaggatgatataaatcaggaaatgtgactgacatgactgcaatttgcacaaatccaagagggtatggtgcctacataaggatcctacaacatagtttccatattttgtataattgaaactgctgtgctgttttgattgcgttctctctctcccttcctctctctctctccacccccactttgctctcttgctctctattgctgtatgatcccaaagagcatgatgttatttttatgggtatttatctactgatactatacaggtattgatccctcattctgtcttcagcattgctggaaatgcaacacaaatgaactaaggaaaggatcttgagatgggatcatcctagattacccagatgggccctaaatcccataacaagtgtccttctaagaaacaggagaaaagacacagataaaagtggagagaaggatgagtccagttgagaatgagttcctattaccggtgaagaaaccattccaattgcatccagtacatactaaaggaattcaaatccctttagggatagaaattactgcttctccaacctctgttctattccttctttcatactcacagaaacatgatttacttggaagaaattcgtggagattctgggatctcacagagaatggaatccttcccagtcacttctcagttacctaccacagaaaaacattcctaacagatacacaagtgagaattgcaaagtgagaaatcaatacgggttacaggaaacacaagatctaagaccagaggtgtgtaaaaggctggatacattttggagatctgaaagggaaaggaaagcgtactctagacagacaagcctggattaaagctttggggtgagaataagcacaacatgtgtgacctggaatagagaagaccgccctgcctcctagagagaagaagcatggatgtgatgggatattaaacccaggcacaggtttcatggagggaaaggaaagaatgtcttacgggaccagttttcattggttctctcatttccagaataagaatacaactaagtgtgaattaatagttttaactcttaacctaccactacccaccaaagagtcagagagcactagagtcatttggtgaaacaaacagagaagactaaaaaaaaaaaaaaaaaatcacagtctgaaaattcaagtaacttaaaaatatgctaatcttcctcttctaacagctctataaattctcagaaattttaaaagtacgacaacttgcttgagcattctggctacagaatatcagactggtgattatcactctgtaggaacttaacattgatcagtattttcagtggttttttttttttgacgatcttataaataagacttagtataactaacttattgtgttaagataggcaaagatgcagaatgctaaaatgtttctggaaaaaaaaatccctaaccattctgtttctaatttgtcttattttagttttgtttttcttggtagctgagtacttgcacaattcctcccaacacacttaaacactaaattatgaaatgaaatagtttcaaaggtcctcagtcttaagctgtcctttaaagaacatctcaagctttgacaaaaaccatggccaatctgtacagtggttttaattcttcgtttttactattgagaaatgtatagctcattctttttcaagagcttctagtaaagctttaaaagcaaccaataatgttgtaacattttaaatattggattaaaactctagatattttcttatttagatttatgtctagagaaagaaaaaacaggtgagtagatatgaaacatatctaaatcttgttgaattctagcagttgaagatctgcttcaaataaatatattttcttaaaaaaaggtatctcacaagaacactatacccaggtatgttttattttatttttaagtatgttacttaaaggtttaaaaaattctgtccacgtaatcttgaaaataaattacttgaagatgtctgtgagcttaatgagacatgaataacaatgcaataatgaggtagttattgcataaagaaattgcaggtcctttcctaattccttgtggacctcaaacttaggaagccaagtggatttgcaggcttgccccttccccctacatgaccagtgctgtcctctgagccactgcctcccttaacctctccgagtcttttacccatacccagcattagatgatggtggttatcatatttgagatgtcttaaaatcactgctgtggtttcctaccagttattactaacaatggctaaatcattgccactgttacaacaccacactgaaagaattactaagcaaaagtaattttcttctactgcaacaaaaacagaaaaacaaagatcaatgtaatggatttttttctgccaaggaatttaaataatacaactgtccctcagtatttgtgggggatggattccaggaaccctcagggagataaaaatcctcagatgttccagtatcttatataaaatggcatgatatttgcatacaacctatgtataacccccgccccccgccactttacatcatctctaggttacttctaatacagaatacaatgtaaacagttgttatactctattgtttcttattaatattttgtattactttattgtctttcttgttcaaatattttcaatatctggttgcttgaatacctagatgtgaaacctgtggacaaggagagttgcctgtaatttacagcatctttaatattcttatcaaattattgagattctccttttatttatttatttcttctatttggaaatacatctatcatcacccctctctttgtatcatcctataaggaagaactaagtgtggtttgtttttttttttagagacagagtcttgctatgtcacccaggctggagtgcagtggtgcaatttcggcttcactgcaacctccacctcctgggttcaagcaattttcctgcttcagcctcccgagtagctgggactacaggcgcatgctgccacacctggccaattttttgtgttttagtagagatggagtttcactgtgctgcccagggtggtctcgaacttcttgagttcaggcaatctgcccaccgtggcctcccaaaatgccaggattataggcgtgagccaccgcacccggccctatgtgtgttcttgaattaataatgcaataaagtcagcataaaatctgtatggcttaatatattcattaatttgatcatacaacaaatatttatgaagcatctactatgtatcaaacacttgttctagaaggaggggattcagtcgagaacaaaatagacaaaaaatatgccagcccttaggagtttatatttagcctggacagaaataaataagctacataagtaagatgagcagatttttttttttcttgagacggagttttgctctgtcgcccaggctggagtgcagtggcacaatctcggctcattgcaagatccacctcccgggttcaggccattctcctgcctcagcctcccgagtagctgggactacaggcgcccgccaccacacctggctaattttttgtattttagtagagatggggcttcactgtgttagccaggatggtctcgatctcctgacctcgtgatccgccctcctgggcctcccaaagtgctgggattacaggcgtgagccaccacgcccagttaagatgggcagatatttttaaaaaaattaataatattaaaaatacgcaggcaaaagactgacaaagtggagaatgtgtgaactttttagagacaaaggaaggcctctctgagaatgcaccttcatgtgaagacatgaaggatgtgactgagtagtcatgcagacacatgcaagggaagtccttcaggcaatccacctgtgagtgccaagccctgcctgtaagaacaatgtgtccagggtttatgtttgtgtttgctttatagaaaaggaaggacagggtggcagcagtagaaactgaagccagaagggcaatggtggaagttgcaaaatatataaagtttctatcctaattttaatgtagggccagatgagaggtactagagggcctgggcagaagagtgatgggcactcacagccttgtaaaagaattaggctgccggctcttttgagaagagactgaagaggggcctggagtaccagcaaatccatgagtgagaagatgctgccttggactgtctgattacagtttggatatattttttaaatgaagctaaaaagacctggtggactaaatgtagagatgggtgtcatcaacatagaccttaatgattttggtttgagccattgacaggaagcctgtaagaggagctagattaaggaagaatatatatttttaatgcaagtatgtaaaatggatgaaggcagtcagggagattttcatttccgattctattcttttccacaatgtttatgtgattcataaactactgtagtgatcagagaggcatttaaaataatatataaagttttacacatattagaatgtacaattttataatatatgcataacaaaaaagttgaataactctatatgacttttacaattccaaaaaatatatgacatttaaaactgtttataagtgaataaaaaggctgagtttgctgctgtaagataagcacaagtttttccagagaagcttgaacttgaatcctgattctgttacttgcttattatgtaaccttgtacacatttcttcatatactttaacatttagtgttctcctctttaaattatgtatatgcagcatttggcagtatttgttaattgtgaaaattaagcaaaatactctacatagaggcctctgcatattgactgaataaaaaaatcataatcgaaatcacaatattaatatggcaaacagcaaagagaataatgaaagtaaaaatagcagcttagatttcctgtgcagtccctattacaggatgagcaacattgtggtgagccctttacatgtattgttgagtgcgatctttacagcatacctctaaggtaggtgcccttattgtcccatttcacagaggaggaaaagttaacttgtagaaagaaaatacttcataggcagtagacagctagttatcgcaagacaaaagcccctgaagttcagacctgaaggcccatggcattttatcttatccatcctatccagaaagttgaatgccttccctgagccaggaaatctccacaacagtaagtaaatacctcttcatactcttataatatttaacattggagtaaatccaaggacagccaaaaaaaaaaaaaaaaatgactcaggcaaatggagatggtcttaaagatgaatccagctaatgcagggaggattagaaattaaagaaacctctaagtctgcacagataggggccaacattaattatgattaaacattggaaataatgttcaatctattttctctgaaataggttctttggtaaataaaacagtttgtgtttatattttttctggttctctgagatagttaaattttacacgtcaatttgactaggctacggtgcccaacttcttggtcaaatgctagtatagatattgctgtgaacatattttgtcgatgtgattaacatctacaatcagttgactttaagtaaaaaagatgacccttgataatagagttgggtctcatccagtgaattgaaagccttaagagcaaaaactgatttccctgagaagaggagcctcaagagtctaacacagaaatcctccctgaatttccagcctctttgccctacacattttagacttgccagcactcaaaatcacataagccaattcctcaaaataaatctacttacccatctatctattatacacacaaacacacacacacacacacacacacacacacacacacacacacatccttctggttctgtttctctggagaactgtagaaccctgagagataaactctccttttctttttaaatcagtttccatttatataattttattccctttaataaccgtatttttattacttttttaactttgatgcttttccagtgcttggtgttactttgggtttaatttctggcttgtctcctaacattctaaaggtcaacagcacacaatctaagtattcataattcaaaatgaaaagaaaatcatgaaatttcagaagacatttaatcaaaatttgatttacacctctaggactatctttcaacattataacagaagttttaaaaagttgaatttctaacgctgtagcaacatataaacaaatattaagtcactttttttcccccaagcttaaaaatgtgactaaatgtgaatggttattctctaaagataaaattttgtgttttggctgtatgtcattcttatttctaataagataatatcaacctaacatacctaatgacagtatttaatactcttaggaatgttctaggcaacgcagtttaacaattttgtcagtttttaaaatgtgagagagaaggattatagtcagcagttcctcagaaataaggctgagtaaatttagttgttcctatagaaaccaatcattaaagtttaaaaagaaaggatcagggatggaggcagagccaggtggctgaatagaagcctccaccaattgtcctccctgcaagaacaccagaccgaacaactatccacacaacaaagcaaacatcataagaaccaaaaatcagcttaggtagcagctcagccacagttgggtagagcaccaagcaggctcctgagagcccgattccaggccttggctcttggacggtgtttcttgacctgtactggaccagaggggagaccgctgccctgaagggagagtcccaggcctggcagcactcaccacaagttgatgactcaagggccctggggcctcgaatgaacattggctgtagccaggcagtactcactgtgagcctggggcagtggtggccatggggagagagtccactggttgtggaaaggggaggaaagggtgggaaggactttgtcttgtgccttctgtgccagctcagccacagcagaagagagtacctcgggaccaggagggaatttgccaccctgaagcaaacgacacaagcctggctggctttgtcacctgctgattgtagacccctaaggcctttagcaaacatacaaggtagccaggcagtggttactgtgggccttgagtgagatccagtgctgtgctggcttcaggtctgacccagtgctatcccagtgttggtggccacagaggtgcttgtgtcaccccctcccccagctccaggcagctcagagcagagagagagagactgcgtttgtttgggagaaagtaggggaagagatcctgagaattcttctgcatattatccaagaccatacaagtcaataatgaggggaattttggaaactacacaaatacatggaacttaaacaaaatgctcgtgaatgactagtgagtcagtgaagaaattaagaaggaaatttaaaaaattcttgagaaaaatgataatggcaagtaggtctatgaaaaggtgctcatagcattgatcatcagagaaatgcaaatcaaaattacaaaatataggcaatattattacaaatgccagtgaggacgtggaggaaaggcaacccttgtattatacactgttggtgggaatgtatttatcagtacaaccactatggaaaacaatttggaggttcctcaaaaaactaaaatagaactaccagatgatccagaaatcccactgctaggtatatacccaaaggaaaggaaatcagtatatcgaagagacagctgcactcccatgtttattgcagcacaattcacaatagccaagatttggaagcaaactaagtgttcatctacagatgaatggatttttaaagtgtggtacatatggacaatggagtactattcagtcataaaaaagaatgagatcctgtcatttgcaataacatggatggagctggagatcattatgttaaatgaaataagccagacacagaaagataaactttgcatattctcacttatttacaggagcacttatttacggagatagagagtagaatgatggttaccagaggctgaaaagggtagtgcagggggtagtggggtggggagtggggatggttaatgagcataaaaatataggtagatagaatgaataagatctaaagttggatagcacagcagggtaactgcagtcaacaataatttattgtacatttaaaaataactaaaagagtataattggatcatttctaacacatagggtaaatgcttgagaagatggataccccactttctgtgatgggattattacacattgtatgcctgaatgaaaatatctcatatgtgccatgaatatatacacctactatgaacccactaaaattaaaacttaaaagaaataaaagatcagttcagtacagacagtgcacatccagttttgacaaacttgaaaatatgtttatacagaacaggataaaataaaggctatggggtagttgggattttaaaagttacaacgcatgacaatgcacatatgaatataaattttagtattattgagatgtacaccaaatttagttctcaataatcacattttcagggtctcatagaagtttttataaaaatggatgaaaaacatagcaaagtatagaaaaataaccatgaaggtagttaaagtgaaaaagagatgttatgaccatgatttccaattgatgattggtgaccttcattgattggtgacctagtatgcatttctttgattctgttcttaaggagtaccctcatttttgttcatgtatcaacaccttagtcccatagctcataatcttcaaagaaagctaaaataaatctcatactccatgggacagtcttgattggctgagtttttcaacaaaaacagaagggatctaagtctgtccagccagagtgatcttgggactcttgctttgaaagcatttttgtgccctctctggtcatgcataaggatgcatatggccacagtagctgttggcagacatattacagccatggagaaaccagtgttaatactaagataaattttcgccacagaagatagaacagaaatattggaaaggaataacagaaaccagacttttagaaatatcattgagccaaccattctcaactctgtgtgagttgttatttaatctatatttaaatgatatttaatctatattaaattgaattttctgttacctagaactaaggaatcaggtcacaatacataataactatttttgaatatatgtgttgatagatattaacacatgcaactgaaaacataatggtcttaaggctgtaccatgagagattaaaattttatttaacaataagattttattattttaattgtttatgccaagtctgattttacagtctgggggcaagatgatagattatacaactacattcatagatatgtatgtcaagatgtaaagatattatttttcactcctgtgatagtttaattcttaaacctgtctaaagagaaagatgagtatacaattttccaaagtgcctactggcaccatgatcctgttctacagcaaagtttattttagtaaaaatatgaaaaaacacatccatataacaggaatttaaattacaattatttgtctcacagttaaacatcactatcacacacctatcaaaaaggaagtttaatttttaaaaaaaggaaacgtaagcactatttggtctttccactaatgtcttggtaaactgaccaaagccacatctttagaagcagtgattgttttttccctgttcctctgagaatctacaaataattacttctatctcatttttaaatattgtagcatttttttggtttttatatattaggttttaatatttgagcctgattaaagtatatttatgaacaagaatatactcgataaaacaattagtaaagttgctccaggcactagagggaaaatatgtatttatgtataaaacaagagataaatttgtagcaaatgtaaggtaaacaaaaatgagaatgtgaagttctatttcagaccccaaggaaataaaatactaaaatcagaatgcacaaccaacccttgttcattagaaaataatgtgataaaatatcatttattttcaaaatgcgtgagttatagaataaattgagcatagtcagccatgcagaattaaactccacaagaaaacaagaaagaaatctaaaagatatctgtagcatgggtaagaaaataaaaaattcaccataaacagaaatgatgtttttgtgtaactaaaattaaatatttcaaaagctagagaaaatatctaattactctgtttcctgtatgtatacacaaaatacatatttgttttatgaatgacttttaacttgctaatataaaaccacagcttcaactctttactactgctagcccatattctattattaacctttgtatatgaaaatagtatttttcttaggtgtacttcttcaatgtcaaagctagtaatgtaaatgattaaaatattaaaagatttaaagggaactggtgaatgtatggatgcattggtaagccaaatcaccattttcttcttctctatggacatcacagagttcataataaatattttataagctatatgtccagtgacctctatcatcactaccagttggaatcaactgataagaggtcacatacacagctttacatttaagtaaattacaataattttaactttataaatatatgaagaacagtatggcttttgtattttgatgttttaatatgattgtcaaaaggattatctttttgatatcctaacatgtgtgagatgccatctcattatggttttcattggaatttcactcagtgatgttgagcaccttatcatacatctattcgccattctcatgtcttctagagaaatgtctattcaggatctttgccctctctttaattggtttatttaactatttgcgattgactcatatgagttacctatatatttcggatattaatcccttacaagatttatggttggcaaatatcttctcacaatctgcaggccatcatttcattttcttgattgtttcctttgttgtgcagaagctttttagactgatgtggccccacttgtttatttttgcttttgatacctgagcttttgctgtgacatccaaaaaatcatagtcaagggggtattcctctacatttttttcttctaggagttttatggtttcagagcttatgtttaagttttcaatctattttgagttcatttttatatgttatataagacaaggtccagggaatctttgaacactctttgtgggaatgtaatctggtgcagccattatggaaaatagtatggaagttcctcaaaaaaaattaaaagtctaataactatatgacctagcaacccctcttttcagtatatgcccagatgaaataatatcatacagatatctgcactcccatgttcactgcagcattatttacaggaaccaacttttaatcaacctgagtgtccattgattaattaatagataagaaacttatataatggaatattattaagccttataaaagaaggagattctgtcatttgtgacaatgtggatgaacccggaggaattatgcaaagtttaaaaagccagacacagaaagaagaatactgaatgatctcacttacatatgaaatctaaaacaataaaatttgaatacatagaaatagagcagaatagtggttactggggtgggtgtaaggaatgggggaaatataagtcaaatggtacaaagttcttatgtaggatgaataagcctggagatctaatgtacagtatgagtactatggcaataatattgtattacgtaatagaaatttgctgagagagtagattgtcagtgctcttaccacacacatgaagataacaatatgaggtgatggatatgtaaatctatctgactatagtaatcattttactatatatatgtatttaacacatcacattgtataccttaaatttatacaaaaaagaacaaaatatttttaccatttacatatatctgaaaaatccctttttaatattttcattattatatgagttaatctaatattaatagctacttatatagaaatccaaactcagttccacttgtagtattaaaaaaaatgacaaagtaattaaaaacctcctcttaggcaagagaaggaaaaaataaaatgaaagctttatatttgaggtgatatgaacaaaacaataagttacggttgtagttcattttaaccagcgacttattgtatagctgcaagatctctactgtatcattttctaagtgattttggtcccatccactaatttcagattcccagccctgtattaaatgatttccttgaggaatgaatgaatgatttccttgtgataaatgaatatttctaaatatctaaaattatagctaataagaccaaataaactaaaagcaatgaggaaattgtgagaataaacttgatttgctacaccttatagttaaattatattttatatggattagtttatttttagcagtcaatattcaaatttatatgtcttttttttccaagggacatagaaataagtattgttatagtcagtttatgaagtatctattatgaaacttaaataaaagctaaatgaaaattggatttgtgcaacataaggaaagcaatcactgacaactttgttaaaaggtgttatttgattttacctttcaaaaatacatatcatatgttcaggtgaatgttgttaatttcaaagttgtaatcttatctgtatttcataccccctcacattcttcatatttgcaaagctttgtttttaaaggcatatatattagaccaaagtcagataaatatagtagcacagttcagagactataatagtttatattgtaatcccataagcagattcagaaggaagtttcaaaaaaatagtttccaaaaattatttgtgcaatatcaacatacttagattaaatatatcacttctaaaagtgattcattttggggtacagtatctgctttaaaaatgtgaatctcattagtttgtaattagatcttaaaatataactcagcttgaagaaatttctctatagttcattgatgtgtttttatactcaataaaacaagatgtttaaatatctgaatttaagattcaagtaggataaataaaaagaagcttctggtagctaaagaagcaggtgttaactgaatctaccctgataactcagatgttatgaaatatggtcttttaggctaatacatcctaccagaacattcagaactgaaagtgattaacaagccaatgcttcccaatcaataaggggatgcatgcctactattagaaatgcagataagatgtatcatgcatcccctctacgagtcaacattttaaaacacttattaagaacttgctatttgcaaggcaatttagaagttcgaataaaagaatgtgggtacgtatgaagaaataaccaaagacagaatgtgattgtctaaagtataagaatattttcattctgacatttattttattaaatataatctcagttacatgggaacaaagtggagggatcacttatctgttttaacgaggcagtttttcaataattcaaaatataaggcaaatcaattgtattccattgtaaagaaaaaaatccatattattttgtagcattataacacaagtaaaacactatctaatgtctccctaattttctcgtttattatttgtcttcctgatttttttcattctatatgttattgaagataaacatctattatttactttaaaaatagttctaaacaatgagaatagatcataactattgaattataatcgacccaactctgtgtgcctatagaattaaaacaacctagatttgtcatacaatatcaatacattaaaaatgtttactaaatagtatgagtggtaatatccactaggaacttacatttttagataagtcatgtatagatttgttcaaaaaattatgcttttaaaattcaaaattcatacattaacaactattaatcaggatgctgtgatttttggcagtaaaaaacgctatttattgtattatttattctattactttactttgagaagtggcttatctccaattagaaaaataaatatttaatttaaagaaattaacatatatatttgaagaagacactgtccaatctggaagagtatgaacctggtaaagatattatatggggatatgtgaaagctgaattaacgtacatttttttctggcaaacaaaagatttcatttcactgataactgaaacaaaatggtgaaataacaggaaagagacataagttaaaagaggaccacaaaaataaatctcagcttggaaaataccattctgcatcaattctattggtgaaaggagatgagagtgaaaacagaatattaatgctgtaataaacaaacatgaataacagctataaattaaagatatatatctgatatatatgattactgaaaaatataagtgaacaggataataactattcctttaaaaaattaagtgttgaaaaattcagggcaagagatactaaaatgaactcaaaaatctcaatccaattttcataattattcgtattccttatgaaatcaattatttgcaaatctgataatattttgccaaatgttttaatttactctttttattatataggttgataaaattaaaaggaaaacatttgtttcccattgtctgctttttatacaaaaggagtgtctactttactaaatgacacattttctcaatgttaatataatccatatgtgaaattatgtagctaaatattccttaagagcacatttgttctattttaaaaatctatgctaaaatcacaacaaaaacatctgctcatatctagaaatgaaagtatttttaaaacataatttaaattctatgatgtgcacatcactctggaggaagatgagtattttgaagaaaaaatgttcagttgcatttcacaaaaaggccttcttagtgaggagagaagttatgaaaatagatttagaataagaaaagtacacaagtagctatattatacttaaatatagcatacactgggttacaattcattttcttcgtacaaaacaataattttgctaaagcaccaacactgcttggcagatgacttagtaaggtgtgggcagcagacaggagaaatgaaaatgaattgggctagaaaatgatggctgctgtcaaggattgacacccagagagaaagtccaattaaagttaagaaatatggacagaagaagtcctagccagagaagtctaacatccagaatctataaggaacttaaatcaacaaggaaaaaaacaaccccagtaaaaattgggcaaaggacatggacagacacttatcaaaagaagatatacaagaagccaacaagcatgtgaaaaaaatgctcatcatcacttaacagagaaattcaaatcaaaaaccacaatgagataccatctcacaccagtcagatactattaaaaaatcaaaaaacaacagatgctggcaaggctgtggagaaaagggaacacttactcactgttggtgggaatgtaaactagttcagccactatagaaggcagtttggagatttcccaaagaacttaaaacagagctactgtaagatccagcaatcccattactgggtatgtactcaaaggaagacagatcattataccaacaagacacatgcactcataagttcattgctgcactattcacaatagcaaaaacatggaatcaaattatgtgctaatggtggattggataaagaaaatgtagtacatataaactacagaataatatacagtcatgaaaaagaatgaaattatatgcctcttagcaacatggatggagctggaggccatgattcaaaaattaatgcaggatcagaatactaaatactacacattctcacttacaagtggtagctaaacattgagcacacatggatgtaaacctgggaacaataaacactgcagactactagagagtggaggagaggaagagggtgtaggttgaaaatctacctattggatactatcctccctacctggatgcaatatacccatgtaaccaacctgcacatgtgccccctgtaactaaagtaaaagttaaattaagaataataaagaaatccagtgtgtattttatacttacattacatttcaatttggaatagtggagtgttcaatagcccatgtagctagtggctgccctattggacaacacaggcctggagtttttctggaagaggcctcaaaaaaaaagttaacaggggttgcttctcaggaagagaactaagagactaggggtaaaaagagatagcaaccttacttttaaccacaaacccttctgtattgcttgaattatgtgtcaagtatatgggttgtctgtatagaaaaaatacaccacaatagacagacatacagacagagtctttgggcaacactatcaacagcaaagcttcaaagtcagggcaaacagaaagcagaaactaggcagaggaaactcacaaacagatgagtttgctattgagtcatgtgattaggctggtcctaaaacaggctacacaatactgcctagagtgggagaaatatgataggagttcctatcctaatcaggctatagactatctaacaatattatgaaaatgaaacatcaattgagggtttgtctgaatgtctgattccatttcaaaggcagtttatagttataatgagtatcatgcaacatgacatttatatatccttggaatttatcaaagaaatgtaagatatttattttgttttcttccactgaaactttgatcttttgaatttactcctacaggtaaaatccttgtccagttttgcacagagatagaagccatgaagccaggctagttgaagtaagtcaggcctatgaattgaactgaccctatcttgtatatgagtttcaataactgggctactttccctccttccatataagcaagcaccattctgaccattaatttcaggagccctttcctgctcttgtctctcaggcctaaatccttttctcagttactaaaaagaatccatctaatgccgaggtcttttctcttcagaccaaccactaactgcctacctctcaggacttgactctatttttttttctgatgttgctggtatgttagtctggtcttttattaattaatcaagtgagctttttcttcccattatattcttataattgtgtctggtctttagtctctctggcatttctctgacctctctcactgtcctggaaccatgtggaaaataccatgccatctctaacatttgcattcttcattgcacatggttcaggccacagcctgtgtttgataaatactaattagctggataaggaactaagtcatgatgccaagttgcaggattattaaattataattgtaaaaattacatttttaaaataaaatgagtgaggcagacacagtacccttaagcctagtgaatatgatgtttgatgctagttatacatgtgatagtgctgtatgctctcatgaaaggtatttctgaaagtttattttaccattttcctcctttttaatcttaattttatcattcattctcctcactgtattatttttctgtatttttctcaatgttctcattttccaattttccttattctttaatgtcaatgtgctattttgtattgtattttcctctgtattagttcgtttcaagacttttctccttttattcaaaactcttaaccaacatcatttagtctggcacagcatagtgagctcagcaaatataaaagtaaataaataaacaaacctgtgccaattttctggttgaaatctgaaaaaatattactcaaaaggttgactctctattattaaaggcatgacattaaataagaattatgtttacaacataggaactttacctgctgaagttggttcttcttcatctgatgctatgataagaggaaaaggtgaaatgggggtggggtagaagtgaagggagggagaaggggggagagagaaagaaagagaaaaagagatattgagattgaacataaatatatttcacatttccaaacactaactacaagcccctgacttgtaattttgtgtatacattagaaaattgtcatgatttaataacagattaatgagtattcacattaaataaaaacatatgtgctcctatactttaaaatatctattaatatttgttagaaaaaaattgaattgtctgaatttgattttcctttgcaaataagattaaccttagttaatttgagtataaattattataaatattgctgctgaaaaatatggattgtatataacatagagctaccccaccatcaattttctatttggcaaagaggaattaaaagtcatggctgatggtcaaaaattgtgttccatgagatagaagttataagaaaggaagaattaaacttcagggtgactcaaaatcactttggacttttctttttttttttttttagatggagtttcactcttgttgcccaggctggagtgcaatggcacaatctcggctcactgcaacctccgcctcctgggttcaagcaattctcctgtctcagcctcctgagtagctgggattacaggcatgtaccaccacacctggctaatgttgtacttttagtagagatggagtttctccatgttggtcaggctggtcttgaactcctgacctcaggtgatccgcctgcctgggcctcccaaagtgctgggattacaggcatgagccaccgaacccggcctggacttttcttaaacatgaagattccagttctctctctctctctcccactacgtgatgtgtgtgtgtgtgtgtgtgtgtgtgtgtgtgtgtgacatacacacacttacatataccacacacttcaaaatttagtagtgatgattctgtggtaaggacaccggaacctgcattttaaagagtgaccccaggtggttctgacttatgttctgcaacccacatatggatacacatagacattataaaagaggaggccacaatacgaaaatacaattttatccttgggtagtggttaccaaccctgtaagtatattagaattccaaattctgggctccacatagaaccaattaagtcagaatctttacatggtattaacttgtagccaggattgaggtattactaggcaatatcaatgtaagataacattaactgtaactcatacaagtgtgaatcttgttgattcctgttttaagaggtaggaaggtttgagagcagcaagattccaagggcaataacctactgccctgtgtatgtggaggatggagcacagcaattacaagagtgaaaaagaagtttgtctgaagcagcttcacaattttgcctagaatccatctattcacttttatacttcaacacacactctgtgaagaagtatttctgctctgtacagaactgcagtttacccagaatattaccgttgaattatatgacacaagccagtcctatttcacttgattcatgaagttttaaaataaaaatttactcagctgaattgcttataaaggaactttgttcccagcggattcgttaatcaaggtatcactgtgtagccagggagtggtctccactcttttccgttaaggttacatctgcgcagagtacacattagacaagctgactttgtgtcctgacagtgttttcttctcacactgtttggctcgcctccttggcacataaagaaatggagagagcaaacacagttggcatgcatggcgcagagaacataaatattttaaaagctgtttgccgctttatcatgtccaaaatatatcataacatgttcaaagaggaaaaaaaatggtagcttccaggaattcccttttaggaaaataccacaggggcttgcagaagtgctgacttagatgagttattgttaacaaaatctagagattcaaaagaaaaaaaatccttacacttatggctggtcactttatgtgtatgaactcatttaattcacaaagcaaccaatgagatgaaaatatttctcatttgataaaagaaagtacagaggttcagagtgactgaacaatctgtgtgagttcaatttgaatttgagctcatgtcagtgtgactttaaaactgaacttcttctgctgtgccttattgtatcacaaagtgctgattccgtttctacttaaagataaaaactagacggcagagtttaccgaaattcactaggtactatttaaagtgttgggtcatgggagtagttatgctcctaataatgttagctggacttaagcataaaactgggggagaaaagaaagaaaaattgatacagaggctgaggagagaaatcctttcaagaaatggagttctttggaagcttctccatttcccttacaatccagggacagacataggcagctgagatcctgactggttaaacaaagcaccctaaagaagtgatgtctaagaaggaagactggaagttgctaagattttacttttccattatgtaagaacaagcaagaaattttaggaaggaattagcaagtacagaaatgaagacaattccaaatttagtaagagtcatagtaatcagaacctttgaaaaagcaaatcccacagggcaagctgtgcaccaatctacacttgaatttgcaatacctgaaagtatctttgttacaaattaacagaattacagccagcaaatacacaactttgcaaagatttctctatgtaacatctacatagcagtgcttccttgatatgggtagatgtcattaaccaatattcatactattcacactcatgaaggcatatacacaagggttactattggtaataatccagctttagttatctctgtaacaaaggcagcatttcaggctaactgctttactgaacaaaacatcatcaactattaacaggtggcaactagagccccagagtaaaaataaacctcaaagtgggcattagttgccttattaatgacatttctgcgaaacaagtatcacagaaggtactatcatgctacccaaatgattattctctcttcctctcagaagtcataaaatcagcaattaaaataaaaatcagagtctatggcacatgtagtctcttctaattctgggaatttaaacacattcaccaagaaaaccaaaaataagcaacccaacaaataagtgtattgctccacttggtcagcatttagaagaatgtactgaaattataatgatggtaggaaaacagaggtaaaaaaatatatcagacatatagaatttaagtaagtgtaatcctcctatcacccataacagaatcttcctgggtgtctgttaaaatgccccacacctactgaatttgaatattgggttttagcccaggcttctgcattttttataagttctgtagataatcgccacgaacactaaatattgagaattctgactctaacccatcaaagtttatttcactgggaaacagccatgggtaccattgttggaaccacagcagtaaattagtaggcttacagaaaaccctttgcaatttatattccggttgtttcacgagatttcaacactgttttcttgtatcatcttcagatttcattgggtatctatatcaatgctttagggaaagatgacatcccctttggatttaataaatggtctgtatctcagaactaactaaatctgttcccttttcttggccacagttattggcctagatataggcatgtgacccatttggggacaaggatatgtaaggagatatttgtgtgtatttaggtggggagaggctcttggaaaaaaaaggcctcctcactcttctcagaaagtgtctggaaataaccccttctcactctcctttagatgtagacacagaggcttgtggccccagaagtcattggcatgcaccttgcaaccatgatgggagacagatctggaagaaagctgatcctgctcaaaggcagagtgcagaaacaaagattttagaatcttgatgagattgttgagccactgaatcatatcaaccatgaatcctgacctttctttggacttctagttctagggaaaatacatactgtgtattatttgagttgagctttttgttatttacatctaaatggcaatctgctacaatcctaatcagttttgttgttccttttaaaaatattagaatgcataagaaattaattatctgaggcagctgagaccagaagtacacacagcctcaggctatgcattcagtgggcagctgagatttcagtgctttatttttccagggagcttaccaccatgctttgatacaataaacctattccttgatttttaagttagtcgctcttttgcaggacattccaccagtgtacatgttcccatgttcctgaagtgtggtggtacttgggaggacaggaaggcatcatacagactctccttgacttccttcctttcttcctcactctctttctctttttccccacaagtatcaactgtgaagtacaactacccaggcccagtgggccgtatattaccctgatacaacacgatactataacacttaagtttattcattagacagattccagtctctttgtgtggtttcaacaattcttacatattctgtttttgtctgtttcatttttgagtgttttaagtaaacttttataacttggaaattatacccattaaaaacaattttacacccagtgtggcttaccatcaaataggaaaatctcattatgaaatataaaaactacatttcttagtatattataacatattttacatgtgaatgttaattcagagtgacttattgatccttttgttggctatatcataaatttggttaagcatgtaccaaatatgttttcaagcatataattatctagtcattagttatttccataacaagaactatgtattattgtattctgacaatattttacaatgttttattcaactgcagtgatgcaaaaatagcaatcatgatatttatgcttgattatttatgcctacccagatgtcaagtgctctacatgtgtgtgtatgtttgtgtgttgagggaagcagaggcattactaaaattagagtaaactattatttaaatttgtgaactcagtcattaaagaaggatatggagttgcctgcggacgtatccatagaagtactgagagagaggtttgggttaatttggtttttgttttattatttgtttatctgttgtccttggccaatggcccaactgggatatgactttgtacttaaaggttgctattactaacttcttccctgtgaaaagtataacaaagatgattagtttcctctggccaaatatttcagacagcatatgatgtggtcaactccacaatctcagaactgcagagtatttgggtcactgtgaggcacagcattggatttgcatagaaaatgcttgaataatcaaaatgtttccattctatcaacattttacatgcattgtgattcctgtgcaaaatttggagaatggcatccattgaagtattgataatatataacacataaaacataattttgtacacatgtagttagcatgtaaacatatattgaatttttattagtctctcccattagactaagagtttcatgaggacagggctgtagcatttttttgctcaccattacatccgtagttttcaaaacagtgtctggaacactggaggaactgaataaatatttgttgaaagaaaagatacacaaatgtttaatacagtcatttgtattaaataaagctcagctgcttcattttgtaatattattaaattaatcaaagaaagccttacatctctgtatatgtttcatcatataaatatatacataattatatatagtttctatagctatatgtcattatataaatcagattttccttcttggggtaggaaggaaacaatataattattataaagacaatggttgctctaaagaccattagattatctcatgaaaaattaaatctgtgatttttaaactaactcagaaaacatgaaactatgatttattaattaagtagattcatttaaacagaaccacaaaatgtacttttaatgtttagtggtgatatagtttacatgggttttacaatgtatttatacagtgaatcattttaacagcaattaccagtgcatttgtgattctctcattttagaaagaggtataaatgagaaaaataacaaaaaagaatgcaagctttgggttcaatttttgccactgagtaagaaaactaaaactaaactgaacaaaaacacgtattttataaaagtaagccagagtactgggaagctggaaagtaatatgactcaaatagcctacattcatatcccagctgttattagtctttgagaacataattaggacaaattctcttacttaaaggaagtagtaaatatctttaagttaggtgatttgatataataaggggacttacaattcaatattttggtgtatctattcaattgtccttaaatatcctttgtttattaaatgtgcccttcctccctatccaaacccaaaccatccttgtcgactgaattcaagtttcaccaccttcaactccttagtatttatttcagtctccagatattcccttctaaccccactaccttttaaactataaccgaaagccagttctaaacagaatggtacataatattttccagctttgtttcccaagctggacattattcttccttggagggcaaatgttttaattttgcacagtgtatataattggttctgagtaaatatttttggaaagttgtccaattttaaattgagaaaatgaagtccaaaagtaaatttaatgactgtttttaccctttttttttttagctttgtaaaatgaggattgaaaattaaacctaagaaaattcatgggcaaataaaacgaagaaacttgtaagggataaagcagatcaaaagttaatataaatgatttctcagatttatccattttcaataaaattaataaattcataatctttttgaaaatttaatacaggaaagagagaatcattaattctacaatgagaatgctgtttaatgtcactagagaagccatgaagccgaggctaccagctcactagatatgaatttcagatggtcacagcatccatgttattttgtttcatagcacctgacagcaggaagctgatactctcaggctcctttatgttctatggatttctgctttatttatgtgtgggagactactcacttcaacctcaattcatttccctaagtctggacaaatgagctaatctaaaaagcaaatctgctaaaaccaaaagaacagaaaactaaaaagtaatgaattgatcagcaatactggcacaaatctcagtgacagtatccacttaagaaaaccacagaatcattgcacataaaatgttaatgctggacaagacttaatgattaagagtgttgtcaaaaaaaaatccattggtacaatgggttaaggtttgcattagaaaatagaagtatatttattaaatcacctaaattactaactaaaattcaccacaagcagaattttgaagtaaatggatatggcataatttgtttcactaagtctttagtgaataatacttggatgaattccaggacttctgtcttataaatgaggtttcaatgaataatcagatttcatttgaatcatggtagaaacaaagaaaataaattatctaatacttttattaaataaagtccataatcctaaacacaatgtaaaatatttgctttttgtaagaaagatttttaaaagatcctctttgatgccatcctttttgatgccatcagcctattttttaaaaaaaggactatgcttcttaaatatattggatgatattatatttctgccattttcctgtgaatgttactctcttgctttaataaagttaccattaacagagatatagtaaaacttccaatgtctgatgtccaatagcacaaaacacagagacaaacaaatgactgatccatgtgcctggcagatgcagccttagaccaattactggtttccctgcccatcatcccaccccagtagagatgcttagggctgaatactgaatattctgtgtcttctgagatataaataatataaaacttcaatgcttttaaaaaataaatggtgatgaatttaaagatagaaaattacttcatggtagaatcttggcaaacggtgtgtgtgtgtgtgtatgtgtgtgtgtgtcacaaccaagtatttcatatggttacagttatttcaaacatgactttttaccattttaatatctgtgaggtcttttagtaaaatatcattgccttttcattgcttatattccaaaataattcagaaattttacaatggctttgaaatgatgtgttcccaaaatatagatcgacacatttggcttaattaaaatatattttgaaattcaaaagatgaagggggaagaaaaaaaaacagtgggcaggtctaacttgaagaaagatgagatatttccgtgaaatctgtacgtgtcattttggtcagggggagttatctttttcatgtagttttaactcatctcaaggacactaaccataagaaataaagcacaatttctgcttgattacgtagagctaatctaatgtgctactgcctttatgtaacagtgagttaatgactgctttagaggattttttttcttcctgttacaacaggagctaaaattaaatgttttttttttttttttttcagaatcattaggaccttcttgaaaggaaaatagtgtatccacatttgggtgttaatcatataacattgacaatgtaattttcttatctgcaaaacttgtctccctaggctaaatttctccttaattgggatgtctttaaagaactcaactgataaaaaagtagacaggcctaactttaaggcaatgaaaattgaataaaggtgcaggactattcagggtgggcccacaccacatttttctaatcttttagaatattttcaagtcttgaatgcaaactattaatttctacccttctaacagatccaatctgcggaccaaaaaatctatatatctttcaaaatttctagaggcagggaactcaaaatctcatcaaggaacatgtcatatctctctcccagagctcacctctagaaaacaatggactaatgaggcccattctttgacaggccagtcattcaaatatttaaaagctattgtaattcttttcttaactgagataaatatccctacttaattttacatattatggtatatacaccctagtcatcatttttgttgacctactcttgataaactcaaatttgataacgtattttaaaatatagtaatgagaatggaaacagtactccagatgtgatctaactagcacaaaatacaatggtgttattacctgtcttgtttaggcggctttataacaaccagcaatccaacattgtaaagaattaatttcctttccttccctccttcagctacatcttttttttttaattatattttaagttctggggtacatatgcacaatgtgcaggtttgttacatatgtatacatgtgccagcacatgtatgtttattgcggcactattcacaatagcaaaaacttggaaccttcagctacatcttatggaccaattcctagagtactgggaactggtaatcttatcttcttgctgcctaaaggcaagattagtcagaggaggtcatgcttggggttgagtcaagggagaatataactggcatgcaaacaatgtcaaaggtatctttgcaacgggaaagaattgcaaaattttgcaacaaagaaaagccttaaagacatactttcaatctttcactttctctctagcaaagaatctagtttgcatatatttcacatgtagttgattaaagtccacagacaggaaaaccaaacatttgttctaatggaaacaatttccttagtgtccaaaactagtgtccatccagcagaatataaatattttgtagtttctcatgaaattttccatgtcaactgacatttctagttgtagatgtttctcctggaaaccagctttaaaagtttacagctgtttcttccaataactaatttctggttagaaattctagattaaaacttagcatcaatttcagtcaatgagccacattcagccctttccaaatcaactacctattagaccaagtcctgtcaaaaataaaataattaataaatcaaaaaataaatttatcttggaggcagaataaaactgtaatagaaaaatgtacaatttaaacaatgtaatcctcaaaagaaaagcctgaggtagtacttaaatgctgttcagataagagctttgtgttcttttgtttttatgattacacacttgaataatatattatcaagggaagttatagagtcatatttctgggataattttggaaataacattgaagactatattttggttcaaggagatgaatagaggctctatatccagggtctccaacttccatggggcatgaaccggtatgggtccctggcctgttagaaacccggctgcacaacaggaaatgagcctgagccccgcctcctctcagatcagcagcagcattagattctcataggagcaggaaccctattgtgagcatgcctatgtgggttatctagggtgtggcctccttaatctaatgcctgatgatctgaggtggaacagtttcatcctgaaactattccccaaccaccggtccatggaaaaaattgtcttccacgaaactggttcctggtgccaaaaaggttggggaccgcagctctatggaatacagatccacattaccttcctggtcttgctcccaatcctccccataaacaccttataaactgagcaaccactaatgctaattcttctagaaagtttccccatgtctcctattaaaacaccttataaactgagcaaccactaatgctaattcttctagaaagtttccccatgtctcctgtttttctaattttttatcattctatatttgcttaaaatgttccaatatcataatgtctacagattaaataaatttccatctcagctcatctcacaaaagccaccacaaccataaaatctgattcctaggacaggaagtgatctttccccacttgatacccatagcactttgttcccctcttatgataattattttctgcattgtataatgattactgatatgcctgtcttaccctttctcaaatgtaagtatttaaaaggcagagtctttatcatcaggtcatagagaaagggtagatcacaggctctccatgaaggctcaatacacatttgttaaatggaagatcctaatgttcttttttccctatgattctatctttatgcaaaaccacaaaaagcttattgttgatctatcatatccaagaaactaatattaatgtgctatcataaattccaacttggtatttattatacctttacaggattcccattttgcaatcttataaataaaaaaatcaattcataacttatttgctctaagcataaggaaggctagattcctaaaggactgattcctaattatgcaagccttacctacattactcataaatttcatataataaaaaatagggctctctttttcccatatgaaatgaagtgatttgtcaaattatatgttgaaggaaataaattttttgaaaaattaaaagctgacaactaaattgcccccagtttgtgtattcatgcaccaacaggaaaaaaaaaaaacaacctgacataaaaataataagtcagtacttattggacatttcaataattttattaatgactaaaatgatgaaagaatagtcagaggcctagatgtttgatttctgcatgtagctttaaaatagtatataaggtttaattatttatatcacttaattagtaactcctgggtggcacttatgagccagacactgttttaagatccttacatatattgaatcatttaatttatacaaaagcagccgggcgcggtggctcacgcctgtaatcccagcactttgacaggccgaggtgggcagatcacgaagtcaggagatcgagaccatcctggctaaaacagtgaaaccccgtctctactaaaagtacaaaaaaaaaaaaaaaaaattagccaggcgtggtggtgggcgcctgtagtcccagctactcgggaggctgaggcaggagaatggcgtgaacctgggaggcggagcttgcagtgagccgagatcacgccactgcactccagcctgcgcggcagagcgagactctgtctcaaaaaaaaaaaaaatttacacaaaaaccctttgaagttggtactgttaaccccagttttacagatgaggaaagtaaggtggagagagattaagtaacttgctcaaagtcacagacttagcaaacagaagtaccaagatttcaactcagcctggctagcttcttaaccacacccccatgatgctgtccttgaaagaatgtgttccttcagatatttacacactacagaattccagtagagcatgctcagcatgtaagaaacactggaattagaagtattatttttggctaggtgctgtggctcatgcctgtaatctcaacatttcgggaggctgaggtgggcggattgcttgagcccagaagttcaagatcagcctgggcgacatggcaaaaccctgtctctacacaaagtacaaaaactaaccaggcttggtggagtgtacctgtagtcccagctacttgggaggctgaggtgggaagatcacttgagccccggacattgaggctgcagtgagccatgattgcatcattgcactccagcataggcgacagagaccctatcttaaaaaaaaaaaaaaaaaaacttccaaagaaatattattattattatttcttcgagtttgaaagtaaccctccccatatgtgtaacaggcacagcttaatttgaacacaagcactgcagtgtgcaaaaagcatggaacaaaattgtaggtttaacacctgttcttccactgagcaggaatcaatgaccttggtctaatcattacatttatcacagaatccccttcccgtttaacactgacattgatattagctcccttgtttattttcaggttattttatgtgtgtgtgtgtgtgtgtaaatgaatggtgcactctgaaaatacaggcaaaattaaagggaaaagggtgaggaaaaaagtctttgtctttggcattacagtgaccgataaactgcatacaaagactatctgcccacacacttcagtgtttatcacctgatgtcctaataaccagcagggctcattgagaagtgagctttactacggtagttgtgggacaggaaagcattgtggaaagtaatacagctggacctccatatttaagaagtaatgaaatctaaccttggaagccagaggctgtgctgtgatgcactccaatttatctattgcctgaagagccaaagtcattggttaaaagatagctaagttgacacaaacagcatgtgtcttgttcttgaaaatgtttgtagctccttgtgtagatgagtaacaataatgagttctgtgtccagtggctccctgtgatttggatgaagcacttctggtttgatttcacaatgaaaccttagcagataaagacattgtggggttatatgaacacattgtattaaaaaggtgttaattcttatttgaaatttgctatattttccaaggattagtacgtaagaaaacaaatatctttactgggttctatctctggctgagagatggaaattttgccctccctatttttctttccaggccttgattaaaataaaaagaagataacaataaatattgattgttgtctattttaaatcatagcttggttaattttatactctcaaaggccaaaattaaatataatctggaaatgattcagcccaattctactctcattatatgactcatttaaaaattgttacccatgtactttaagcatatggattatggaattttcttcacataaatactttgatatatgttaaacaataagttgtcttacagtacaaagtcaccttgagatgtaacctagtttttctatggctccggggaatgtggccaaacaaaactccagaaacgatgacatctactttaagctctttaacaaagaatccatgcctctatttcatctcagtaacccttatgctttattgtagtaattcctcatatcaaatagcatgattctagcacataggagataccaataagatttgtattagatgttacagcaggagtctgtaaaattttcaagaaattaatccaacctatcaaaacacttatgtatttatttacttatttagttagtttgaagcagtctctctcttttgccaggttggagtacagtggcatgatctcaactcactgcaacctctgcctcccaggttcaagcaattctcatttcagcctcctgagtagcggggattacaggtgtgcaccaccacacctggctattttttttttttttttgtatttttagtagagaaaagcttttaccatgttggccaggctggtcttaaacccctgaactcaagtgaactgcccgccttggtctcccaaagtactgggattacaggcatgagccactgctccaggccaaaacatttattttcaatgaattcttaaagtgtcatatctttgtcttcattctatcttctgtgttactagtagtatgaggaaagatgagaacaaaggctgtgtcattcatccgttagccctttactttctttgtccacttaccctaagctttctttgtccacttaccctaagcctgttccatactttagattggggtcctaccagtccgtggcctgttatgaaccaggcagtaggtgaaagagcatcactgcatgagctccgcctcccgtcagatcagcagcagcattaaattctcataagaacacaaactattgtgaactgcatatgcaagggatgtaggttgcgtgctccttatgagaatctaatgccaacccaccttctgtggcaaaattgtctttcatgaaacccagtccttggtaccaaagaggatggggactgctgctgtagatgctctaaaacatgatttaagctttctttgattaaatgcttattccttctctcattggtcttgattttagagaatgtccctttctttatagtttttattaactaaactcttcactcttctttatatacgcctagttctagtttacccttttttaaatgttttatggcctactacagtaatcaaatgtttgaatgaaaattaaaggagatataatcacattatttaaaaaatatatttgataggacaacaatctcttctttttctcttcatgtgtatttttcttttcctattatacaaatcaaataactccaaatctatattactatgaataagtgagcataagtccattaagcttcctcttcattataaatctcaatttctctgatgataacatttcaacaccttgtcataactgcttaaaagttaatgttttttaaatgacttgctttatttggataccatagtttatggtgcaaataacttaatctaaaggaaataacaataggtataatttcctagaataaagaaatagattcatgttgaaaatcaatgaagaagatgaaatcaagtaacagaatgaaagattgtaaagatttttggcatgttttacatagtatcatataagtgatttgtgagtcttctatagattgcttttccatgaaagggaaaagctggaagataaaatctttccagagattaatgctaaatttgccactgtggcctatcactttgaatttgtaattttcattttcataagtgtatagaattatatattttggctgtgccacaagtgatttcaggttaggagtaaaagggcaatttgatattaccttcaattttcaccttcctattttttcaataattttttctaaaatgtaaaaaaaaaaaaaaaaaaatctaagtttttccttaagagattttacctttttactccttataaaaataattgaagagcttttgctaaagccaatgtgattaggatttgtgtaatcatggccatatatttgtgtataacgtaaaaagaaatatctgcaaacatacctatgtgtttatcaacttgttgctttgccaataaaactcttcaaaaataaaattaaaaagagaagcaacattccacagcagattgtaaaactagccacaaactcctccccttcttgcatccgcacatttgtaaaatgaaattgcatatattcccctcaaaagtgttgttagctactgtgaggcaagccgagatttgaaaagtgccttttaggactcgatctttcttactactcttgacacctttgccactgccactacgtaatagtagagatcagttaaccatcttctatccagcgccagctgactgcagacgcagatatgagtgcaacaaagacgtaaaagatgttccagagatgaatatccacttagctgtctcacacacttctgagataatatgattattttttaataaatccattaaactctgtgattatttgttaggcagtaaaatacattcaaatacaaaagcagttattccctatgaataaggacatactcctagaagaaaggacagtggtttaaatgacatacatcaatttcttaatgggtcattgtcttttcttacaaataaaagctttaccacaaactggcttttaccctttgactgggctagagtggcttttggtactcaataatatctaaggttctttgatgttatacatttttttctttctgaaagttaacatataattgtcacagcttggaattgcaaactaacaaattctaatcattgtcattattaataaagcagaaatatttttacatcaataagctaatgagtttatatggtatgttacagaatttttacacatataaaatataattacttttccataatatatgcaaaattagtacgaaaactttcccttaattatctgtcatcttaactgcacaattatatttgtttgtatgaacttatatttaccctttcttattattagaaaagtaagtaaacataactgtgaaaataaatccctttgaccctagttgactggaaaatttcttagcaatcatctattggctagcagctttagagaaagtattttagtccgtgaaacatagctctcattatggtaacttctagaaaaatggattcaatcatgagtctaagaagtaatcttaagtagaggggaaaataaaccaccccgacaactactcacaatttcatctactatctgaaaaatttaactgaaatttaccaaatccctcatttggtaaccaaagtctcgaaatctaaaataaccctacaccacccaagagagctacttaaggctcgttaactttctgatatttcatgaacactaacaagaagtctttcggacaacgtcagactctattatactacttgatattctgacactgattgccttctgaaagataaacatgaatatggctattcatagagtgaaatgtacagtcaacttctagttttttaaaaaatgtgtatgacagtctgtattttctgggataaatatattcaatttttcataataaaatgaaagctgaggaacagattattagtgacaatataggagggtaacacatttaatagaatctgaatttgtggtagaaaagggatatcattaccaaagggaaataagtttctatggaatatgataggtaaaagaggataagagaagataaaacagaataaaataacttttcctgaatatatatatgtattttttacatgatatgctatacatatatatatttggaaatgagaagcctggccagatgtcaatgtaattacagagaagataaaaagaaattataaataaaataatatacagtactattatcctgtactgacctactgtcaataatacacatacttttaattttttccaagtgataatgaatcttatattactaccaaattccaatgtttatattctttgttttgtctgatcattttaacaatattttacacatatttacgacaaagaccattttttaactgctatatcctcagtgccaggaagagtggcacatagctgatactcaaatatttgatagatgaatgagtaagcaaataaataaatagacaaatgtttgttttagccatttaatttttttctacaaattcttctacgtgccacagtcaagctctttctccacaacgccagcaaaactaatcttccgtaaaccaacaagatcatccatcaatcacatgtaatcaaaggaaatgcttatcttgcttaactgctccacagtacttgacactgctgattacccactccttgagacattgttaatcctgaacttactgtgcaccacactttcctggttttccttctacctgactactctgcctctctggctcctttacagatttcactttctctgcctatcacttaaatattgatggcctcttaccgctttgtatttctaattcctctattctttcccatgtctagctcttctattctttgctattatcctgtttctagacagactcatccattccctaagcttcaataaccatctatgtaattatgacttctacatctatgcttgacttcttagataatgtctatcaaatttgtcaaattcaacatgtgaaatactgaactctccttctgcctcccaatcctgtgtattgtcatttataatatctcagtaaatgatacccagttgctcaggccagaaactggggatgcctttctttactcttagtttctcccaaactctttttcttcataccccataaataagcaataattgtctatggtatcatctaaatactcagtgactctctcctcttcatcccgttagttaccacattgacagaagccaagatcatcatgtctagcctcatctgctgcaattgccttcaaattgtccccctgctgtattttgctgtaatttgttttccatattgcaccaacagaaatacaaaatctcttgtttttcttagtaaaaagttgaaatttttttaaacactgtaccaaactctagagtatctgccacttgtcaccatcctcagagtcagtgctggccaccatgtcccttctctctaagttttagccacatttaacttctttcagtttatgacattatacctttttttttaatctcctggttattctacacactattttctctgtctggaataggttttgttgtttgttgtagtttttagtctgcaatagattgaaattattttttagatttatgtctagatgttactttttcaggttggcatgcattcctttacacttagcttaaagcaagacatctgctttatatttttatggctccaggtacttgtatcacaacacataacaacatatctttctatctatctatctatctatctatctatctatctatctatctatctatctatcatctatttttctatctattatctatctccatctttctgtctgtatgtatgtctgtctgtctatctatttgtctcatcatctaaacagcaacttgtttatcattgcccctccaccattcaagtaactattacttagtaaacactcaataaatatttgtttgaaaataaatgaaaactaagattttatttgtttaaaaaaagtcacttattttttccctttgattacgttaatatactatgtatttgagttgtaaaagtttatactttttactagtttaatggattactctgataacacacataggatagttatgccacagaacttgtacaatttaaaaattctcaagatttccatttatgaactgtataatatatactgataggctgggagaggtggctcatgcctgtaatcccagcactttgggagccaaggtgggtggatcacctgaggtcaggagttggagaccagtctggccatatatatatatggaaagagataatagaacatttatatatatatagagagagagataatagaaaatttctgcatgaaatgaatgtgtcataatatagctcccaattacacagtgccatccaggaatgtgagtgagtaattgggaagcaatttgcggcttagccacatggtggtctgtccacaaatcctctggagagggaggcagcattcagtgcacatctgtgcaaacactggttaatctgggtaatgccttcgaattcaagaatttaaaacaagggctttttctttgctttgtttgaagagaagttttcctactgccattttcagatatcagaagtgaatcttaataactctaagaggctgagcacattgagttgtgtaggtgtgtgatagctgtgtgtggggatacagagaggcagagagagagagagaatgagaatgcagtatacagaaatatcaaaaaatgtccagagaaaagcaatgttgtctagtgaaggaagttcacaaatctgagaaagtcaattctgccaaactatcctacgtaacacaggaatgcaagtgatgtgagtattgattgcaaatgtgttaagtgttttgtgcttatctgacattatatgctttgtgagggaagaataaaagtacaaaactggatgaggatcgcttgaaataaatatcaacaacctgaaacaaagctactgcaaagtagtaaggtttgaggtaaaatcatgaaatgtttttctctaagcatgcatttgaaattctcctttccagatgaactgcaatgaaaagagtatgtgtctgactgtagaataaacaggataaacataattttaaaaactgggatcaaaaaacaactttttctaagcaaatataaatgagattattttctttcctttggaaattaaaaatataaagattcagaatttcataatatatatggctcaaaattcatatggtctgaaatggatagaagaaaccttagacacatctctatctttgtggtaactaatatgtaaggaaaaatacagactagtgacagctcaaatattttttgtcttttaagatattacctcaaaatacccacatgtgttttttgtttgtttgttttttaaattccaatacactctgtttcctgcattggtgctagataacaacaggagaacaataacaaaaaagccttggccaagccatttatttttatttttatttatatatttatttatttgagatggagtctctctctgtcacctaggctggaatgcagtggcacaatctcagctcattgcaacctctgcctcctgggttcaagtgattctcctgcctcagcctccctagtagctgggactacaggaacctgttattgtgcccggttaatttttgtatatttggtagagacagggtttcactatgttggccaggctggtctcaaactcctgacttcgtgatccgcccacctcggccttccaaagtgctgggattaccgaccagcgtgagccaccacgcccggcctttttttttttttcgaaacaaaaacgcaggatggtctttagtaatctaatgtttgaaatatttgatcccaatattagttttaaaaatatgaaaagacccaaggtaagctagatattaaaggcattactaccaagtattactatgcaatcaatatttagtacacctttcatatgcaagaaaatatgaagctaagaaaaagcagtagaaaggcaatagggtaatgtttctgtcataaataggtattgaacttgaaaactgtgcttgatttctcattattttctgatcctttataaaaattacgtcataatataggaaagttgtattcaagaaactgtcaacactttaagactttaggaaagttttttcctagtattttaatgttagaacaccagcacatgaaaatagaattggtgtaactaatatcctatactaaatgatcaaacaaatacaaactaaatacatttcttccaaaaactcctaaatacagcccagagaagaatagggttgtatgaaatgtataattaaaaaatatagcttaaaataatacagtataactatccaatttctgaatatcagagatgtatactaatatgtaataatgaatctgagtagaatttaattctataagcgtttaatttcccaaagtcacactgaactaggtgggatatggcagcgtgcttagtttttaaagtgttgctgcccatagtatcagtcttcagataaaatgttgaatgttggattaatatttaaaagtatagcccaaaagtatacaagtatttactttaaaattcggctggccgggcgcggtcgctcacgcctgtaatcccaacactttgggaggccgaggtgggtggatcacgagctcaggaaatcgagatcatcctggctaacacagtgaaaccccgtctgtactaaaaatacaaaaagaaattagccgggcgtggcggcaggcgcctgtagtcccagcttctccggaggctgaggcaggagaacggtgtgaacccggggtgcggagcttgcagcgagctgagatcgtgccagtgcaccccagcctgtgcgacaaagtgagactccgtctcaaaaaaaaaaaaaaaaaaaaaaaaattctgctaagatactgatttcttaatcatttacctacatttgtttctctgattccagatttggatctttcaaatagtgccaaaaatattatatactattatacaactcgaaggcactgccaatttggggttgttgggcttaaaatacaacactaaaattttactctattcatacatttctactaggggtatttatgactctaattttcttcagatatacagactttcctgaggatatgattctcacattaaactctgaaactcaaatgtacatatttgaagcctgggtcaaagtggttacaacagttttatttcgatggcactgtgtcaaacctcctaaaatatcagtgagttaataaaagcattaaaagagaattatctttgaagatgaattaaatgaacaaagtacctttcagcaataataaacttctttagataacatatattcataatgcaatataaaaaataaggaaaattcattaaaaaaataaagcacactacaatccagtaactaatggccaaagatggtaaattaatggttttatttaattattctttctttcattcaaccaatagttactggatttttactatgcataaggtaattaagttaggtgcactgggtacaatgatgggtaattcagactgatccctggacgctattacttttctttttcaaaactatttccccaaagccattgaagtgtcctgtttctctaaggtttatgcaggttgacaaaacatgtttggtttcctataatgaacagatatattccatcttgtactcttcgtggtactaatgcgaaaaatataaatttttttcaaacttacctgtgctattaactttgaaaattatttctctctttagttagagagaaaatctctgcacaagtttacatggtgttaaattattttaaagtacagctatttccttaatggggacctatgtggaaattacagaagttactctaaatccataagtatacatatttcgcagattttttaaaaaactatttgaatgtaaccaatgacacattaatttttgcagagcaaattttttagaaaactttgaagagcactgcatctggaatatcctcttctttatatgcttagaaatataaaatatatttatcacctaagaaaagtaatgattagaacagctacaaaatgctgatggatattcgaagtccctaaaaacatcctgttttatttacagtgataatttaacttgaataaattgactttggagttatgtattttatttgagaataaaatgttaaatttatattaatattagaaatataagaaatgttatatttatgtattatttgtaatgtctttaaatttagtgttaattactaaaaatattttaaaacttaaagaacacaattaatataatttcaatataaactggaaatgatacaactgagaatcctacacaaaagtaaactaattagcaacatatagcaattttacaactaatctccataatgcaccacagccaaactgccatttattcatggaaataaaaagataactactgaaatacttaaattttgcacttaccaacctccacaacactagaacagttggggtctgtgaagccatctggacactcacaggaaaaggaaccatcagccaatcctggcaaacagatacctccattttcacatggattgggatcacaaatatcacctaaggcataaaaaaaaaccgaaattgacattttttttttgtcttggacattgaaacatactagtttactttgctatggatgttcccttggcaaagtcaaaagtcagggtaatattaagattcacacataagatctgcaagactcatttcaaaccatgtactcaaaaaaaaatactatgtaacatggcaaaaattaaactgcataattcaaacactgcctctgaaagctattggttcagtttggagttccttcataatatgtaaagagaatgttgtctaattggttaataaatattaacctaaatatctgtaatagactagtgtcattaattactctaataaataccttctttatatccacacagtttactctttaactctttaaaggacaggagtttatttctggatccctagaatctgggcttgtccatgtgacttgctttggccagtaggtcgttaacagacttgaagacaacagagatttgaaaagcacttgaagacatctacttcctctcttggagtgctgagatcgtcatgtgaatgaattcaggctagcttgcttgagatgagtgaaagaaatgtggaaggataagaaagaaactgctacagagaaataacttatgacataacagaaaccccacaatacgtggccttggctgtggcaatgggtggcagatagtatctggaaaagcagtcatggccatgaaaagctagaaaaatggctacccattttatgtagtgtgtaacaattgataaagctgtcatctgaggtaactggggaggtagaacatgtatgcgatgaacttttcatatgagtaaggagatttccgggcagactgttaaagcatcagttggctcttactgcctgcatatgataaggtgctacaataaagagatgagctaaataaagaaccagtccatttgaaagtaaagggaagtagtatacaaggaccaggacttgtgttagaaaacacaattgtttctaaactcccaactctcaaagtggtaaattatcgaatgccagaaagacatggcccaacataaatatcaatcatggatgtggctacaaacctccctgtgaaaacatttcaaataattcaggtggagcctgaaagatcttctcagctaaataaaagggcttctagagaccttaaggattgtccctgagaaggctgacacacccaaagtagcactgattaagtctggagtaaaaagcaggcttcagacagaatcatgggtgtggctttattgcacacaggatttgaatcagatgcacaaaaacccatacagttttaaagggagctttgtaggtgaaactgccacctcctggactcaatgagtaagggacttttcaaaataaaaaagcatctgggcaccaacttcctactagtttgtatttcttagttatgttattctctgtaaggtttttcacatgagaattatttaaactcttttccagatgaagcactttaaaaatatttgaaaaatgaaaattcaggttatgatttctgtcaaatataaaccaagtcattagccacactaagatgatagattaaaacagtacctaagtgctggagcagaccttagaaaagagagtcataaaatgaatgaattaatgtttggggaataccaaagaatttagcgtggctggaccatggagtatttaatctggaatggctaagaaagtataaatatgttagatcagggaggattaaaaagtgccattgtaatttttaagataaggaatcaatgagagagtgtctaacatttttaacatgtattttaaagtttggacatggtcagatctaaattaagaagacaatcctggcagcattttgaatggggtgattgatgactgataaagatacttcagtagacttgctatcatttatatacttatcatctaactatctatctatctatctatctatctatcatctatctatctatccatttatccatccacacatatagctagctagctatccttccatttgtctatcaatttgtctatctgtccttctagtccttgagtacctattgcatggtaggcaggcactgaggtaagtgctgtatataccaaactaaataacagactatggagcttagtgggagagataaaaatgcaggaacaattacaattatactacacagtagtaacacctgcaactggtatacatgatccaaactgtgggaccagtggagacttttaaggagactcagtgctatcaggtgatgaagaggagagagcgtatgcttaatattccaggcaaagggaataacacacttaaaggaaaaaggtcatgtctcattccaggaacttcaggtaggccactgtagctagaatataaatacgtattagaaatagaaaatgatgaggtccaaaaggtaggaaggccatatgaatcaaggtcttgtatgctgtgccaaaaattttggagtttatcttcaagcactggaaaattataaaagaacttgaaatatgggaaagtgtatcaccacatttgtgctttggaagaatcactaaggcagcaatgtgttgaatcagatggaggaggttgggccgagggaaaaaggaaaatgcatttattgtttgaagtagtctcaaaaaaaatgatgaagattctcttgacccttcatagaggtggctacagacagggaaatcaaaagaggcatcatttaatatcaaatctagttaataaatactaggtaatgaaaccagaataaaagttcccccaaatcaagacccacccacctatgtggagtaatcagtgtaaggacacagtctcatatttacatatttacctaaaaataagaacccttctttcagatcccactctgtcctataaccaagttcttgcatcagatagtaactgaggtaggcctacagtcctgatatacccagggccaaaggaggttctttcaattatcccatcattatggagagtgccttaagaatcctttctggtgccttaagaaaccttccatggcccctctgctgccctctctagatgataatgctaaatcgagtcaattttctaccaggcatgtgggccagtcatatcatgtttctgtggtcaaaatgagacaggactatctgctcaagtctcattatatcttagagatgccaactgttgtttaactgacatgtttttctctcttctccttgtaatttttgttcttcttttttgcttatggaaacacatttctaatacactcgaaattttcatcttatttccatcattagcatactatcttttgaaagggagaaaacaggtaatagatttgagaaacatgtacaaggtagaatcaagatgatattttgaccaaattgatccaggggttgaggaagagcaaaaaatttgggttgatttccagagctcctgcctggatgattgagtagccatcctttataaggaaatatagtagattcagttttaaagggattattgtatttgaaaagtctgtagaagatctaaaatgaaaatgtccgattaagctattatataagtagatgtagaattaaagagcctctgcttaaacatgacttgttaagtatgaaggttaatactatatttcactgagtctattaagggagggcaggggaagggagtggaggggatgagagcaaagagaaacgaagagaggagaggtccttaggcataccaacaaataagtgaggaaaagatataagattcttcataaaagaaagaagttaatgcttggcccattgtagcccggtataaatgttcagtttattaaactgtggtctaccatgtcaaagtctttctgaaattaataagggccccacatgcaactgtgttgggtggacagtggcaatagaaaccaaagttttgatcttggacaaagtagaggataaacaacaaacataattagggttattatagattttgtttaaaatctgtttctctatacataatcattagtagcatgctttaatcagatgggttctccaagaaggagatgctaagatgaagttaagagcgtaacaagtttattgagaagtaatgtctgcgaatgacaaaatgaggaggaagcagaaatgagcaggaaaagcttcaacttgcgatataggtatgacaccaataaaaataaatgaaagacatgagggtggggatggtcgggacaggattgaccagggagagcctcagtctataatgcagatttgagaaagtcttagtcaatcacacagggagctccagagcaaagattattgttggaaggaattcccctaggtcaggaatgacaggcactagggcaatccaggtagagtgagggcctaaggctcaagtagggtcctgaaagttctgcaggaggctgtcagctaactacatacttgtagctggacagcacattctttcttaaagaaggattagagccgtgcacctccacggggacccacaaacccctctcactctcaaaactgtcctgatttgaatgagttatacggttacttaggtcaaaaccatcatatctcagcctatttcctttatacggccataatctcagtggttagtacagatgtgggttgataccttaagtgaaaacaaactctctcggctagaatttcacatctaattaaaatacacggtagggatttctgatcctctgtaatgtcagtttatccaaggcagtagcacctcaggtaagaaattctgactaaaatgcaataggttcctagactttaaatcaataattgttttctgtttgtttcccagtggatatgttcgtagagtcttttttttttttttttttttttgagacagagtctcgctctgtgcagtggcgcgatctcagctcactgccagctctgtctcccaggttcacgctattctcctgtctcagcctccagagtggctgggactacagtcgcccgccaccatgcccagctaattttctgtatttttagtagagacagggtttcaccatgttagccaggatggtctcgatctcctgacctcatgatctgcctgccttgccctcccaaagtactgagattacaggcgtgagccaccacacctggtctggtaaagtcttttaaaactgcaatgacaaccagtagaagaggttaggctaaggaaaggaaaacagggcaatataagatttcatggttatttatcctactgtcagcaggctcctaaaatatacttctgcatattgtaatgtgtgtagcattatactttgatgtttcttggccggctggcctcacctgcttagattaggacagatgtgtttaatttgattctaaccatgttttatggttccatctgcagtttatggcagattcaggcaaattaagctcatgccgatttgctttttggcaacagaataaagcaattatttttcccaggggcaagaaatcattgcaggctaaatttaacttactgtttgcctgctctttccacccactctccagagttctgatcggactgcatgattctgcatgaaatcaacattgtcttcattcttctcactgacctcctacttgttgccagtcacctcatgttcaaggtgatttaggcactatcttattttacttcattacccatttgcaatccatgaccttttaacctcaacagcaaagtgtgtgagcacctataaaatactacttggtattgcagaagacaatggttaaaaaaaaccgaaaagcctaaaataggtacctttatgattgtggttgtgcattttctgtgagcttagtatataattatacaacttctcatgccatacaaagaagaaaattctatgttggtactactgagaatcaggtagaaaggacagctgattttgttcactgataattaaactcttggatagtttgtgttcaggtttctttatatgttagtgtttgtctccagtacacatatcagagaattactgaatcattaatcacatattcatatgccacaaataaataaggtagcactcactgtaataaaagccatgagaggagggagaaacaggctgatgagaaaaacagcaaataaaactggttatttatgacagacagtgaagcaaggccttcacaagagctgcaaactgaagaatgaactagaatcagtggtgttaaagcctaacgaagagcattctaggcacagggaacaggaagtggtcagccctcatgataggtaagacagagatgatttcaggaacagaaaggaagacaggggaaaaactctcaataagtgtttattgccagcaacacatttttaatagaaactgattgataatttaaagcccaacatttgatcctctgtgttcctggtaatcaagggcaattctactaagcttactctttatatgcagtaaacatctactgaacatatactattgtattaatatttacaggctaatgtacttatgaatttacatgttgaactctttcttacatattaatgtatttacatagtactgttaatgtatttatgtattgacagttatataaatatcctaataatttatttagatgaatgcatgcttctccattttctctgctcttttcaaagtgctggcagccacctagaatatgtctgcaccatcatccctgccctctctccatttctgtaaagaaatttgtatacagatatagaagtaaaagcaaaaaagtagtaatatatcaccacagaatgttacctcactaacacaagacattattaaatttcttcaatatctcaacaaactaaatgtgaagaacattgcaatacatacttacatatggaaaagtaaaatgcagagacaatttaaattcatgttttgcatctgtgacaatgcagctctgtgcattacaacctcatcttcaatctattgctttcttgttgaactgtactatcatttcacttaaaaactgaaagaaaataaaggttttgccttctattgtagaagcgagagttttgaaccaatctatagacagaatatttgacaaaatgagccaactctagtacacaagtgagtaataattctagttaaaattagataaagttcatgagaatttgcatactcaaattggtaaaactcacagaaaatgttagcacccttatgacttactacctgtgaaattgtgtggaacaaaataaatgtcatttttaaaaatcaacaatagcctcacaatttgcttttgtgcctctttagagaccatttgtgttgaatattgatatttcacttgttgaacattctaatgagtttgatgcataggttttgatttaaagctttttctcacaattaaagcttatgagtgtggccaatttaaatttcaaataaatttgttaagaaggtgcaatctgattcttaccttcatatgtactttaaaagtaaattctagttattattgcagaccaccttgcaatttggaagtatacagaaggaaataagatacaaatgtcaataggaataattatatcttcattgatagaatctgctattttactggtaaatcattagacatccttgcaataaaagaccatccatttctccacctcagtgtccacagaatccaaaaataaccacagaagacaaaaatcaaataaatgaacaaagaaacctcttagacttagactcactcaaaaccacattaatgctaatttaaagcaggacatctcttagatgttatccagtggtttgcctcactatttttaagacatttttctttttagctaggttttcaaatgctaagggtatattgggctgaagaaaataaggagaaaatctgctgttcagtgttgactatttgaatttcacagctgatgacataaggcttcaatcaaggtctactggataaaaagacaaaaatgttttgggctctaacattttgaaaaacaaaatctttttgcatatgttttagtttaaaacactctggaaagtcccttaaaagaacctacagtttctagaattgaaaaggacattcgaaatgaactaatccagtggttctcagactttactgcatattaaaatcacagggccgggggaggcttttcaaatatctcatgcccagtccagttaaatcagaatctctggggatggttcccagccctccacagtttcttaaagctaatccaaatatctcaatttattcaagaagaaggagaaaggaataggaaaaaccaaggaagaaaaggaaggagggaaagaggaagtttggaagttagtttgtattttcttgcctttaattgggagaaaggcaaatgaggaaggtatttatgtgactagctttctttgttaattcactgagttaagaaaaaaatcatttgcaggaagctacaatcagcaaatcataaataagggcactcactatgttagggaaaatagaatagctactatttaatattaacatacattccctacaaacatgtaatccttacaaaataagtagcgaaaattttgtaaataaccaggaaattcaaccataaactacaattcccaaggttggttggttttttttttttttttttttttttttttttgagatgaagtctcactctgtcacccaagctagagtgcagtagtatgatcttggctcactgcaacctccgcctcccaggtcaggcaattctcatgcctcagcctcctgactagctgggattacaggcatgtgcctttatgctcagctaattttttgtagtttagtagatatggggtttcactgtgttgtacagactggtcttgaattcctgagctcagacaatctgcctgcctcagcctcccaaagtgctaggattataggcatgagccaccgcgcccctggccccaagcatttttgactatattatttctacctatgaagaatatccatccaatcattagttaatatttactgaagcccatctatatgccactaagtcataattactgcacatattatagggcccatgatggacaaattcctattctcaaagactctcacaaaaagacacaaataagttgataaatagttaccactgcttgttaggtccaagaaagcatgagagagggccaccaaacccagaactgtgagtcaagaagccttctgagagcaagtgaccttccattagagaccagagtgagcaccagtgttgcacagttctgagggctcagtttagctaagggccaagaagtactgtcttgctttagaaaaggtgatgttccttgatgacctagatgaaggcacatccacaggagtggtaggcatcagtgccagcctgaagtaggttaaagaatcaaaggggtaggtgtattagaagtaatgatgcaattctttcaggagttagatgaaagcatggcagtgtgttatgcgggatataccaccgtgatttaagaaaatcgcacggggcagagttggcatcctactctgctactctctaattattctgtgtttctaaatcattgtttgcttttttgaaaaatggtaatggtaaaggttaaatgttagaatgcaggttacaagtttagtgaagttcctgccatagaaagtgctcaataaatgttagtcaaatacctatagaaatctagtgggacacattttggaaatatatttaaaacatcagaaacctgatgatgtaggtgctgatagaagcaactactagaaagaagtggttaaagaaaacagtggagaaggaataatcagaagggtgagagcatgtgtacaaatacgatgaatgagcctcggagtacatatggaaggattcagctttgactcaaggaggaagatgtaccaggaagtttgagcctggatgacacaaactgaaggagttctggccaggaatgatggctcatgcctgtaatcctagcactttgggaagctgaggcaggcagattgagaccaggggtttgagatcagccttgccaacatggtgaaaccctgttgagttagaggtatactaaaaatgcaaaaattagctgggcatggtggtgtgcatctgtagtcccagctactcgggaggctgaggcatgagaatcccttgaaccaaagaggtggaggttgcagcgagccgagactgtgcatctgcactccagcctgggcggcagagccagactatgtctccaaacaaacaaacaaataaattgaaggagttcccatttgaagttttctgtgtagtaggctgctgcgaatgtgataggaccagaagtttgagaaggatagaaggtaacatgcgcatgcagtaaatagaaggttgttgcctgggaaaacatagaaaaatgatggagggaaagtactgagggcccacacaagaacttaaaatgtcaacatgtaccccactgtgtatctggtcagagctcaacagctgaggtagtgcaggcacgcagcagatgatggatccaggcttgtggttttaccagataggtgtgatgagggtcgacagcaaaggagtgacacctgaccactttatgtttgttgaaaaatacacaatatagcttactgaactttacgcttttagataatatatttttgtaattatgcaacaattacaaacccagaaaattgttctttcagagaagattgcagctcttcagttgacagcagaggacaaactaaaatattgaatttagctgctgtatataaataatgcagcacatcatgatggcaacagttagtccatcaatctctgtcaagaacacaaactcatactgactttataaaaacaatcaagtgctacaaaaaagatgaaattcagtgccacgtccagctgtagaagtttcacagaatcttcttatttagatcttagattgtgaattcttactttttctaagcgtaaatctggtcagtcacatataaaaataacctccaaggaaaacaagtcaaacacaagttggttaacttgatcacttattaagcaaagtcacctaaaagaagaacagaacattttgctaatcactagataaaactgttatatcaatttttcaggcagaaaggtatgtaatgttaaaattacagaaaaaaaattgcaaagcctaatttcatgctttaattatatcttgtttaaaaagtcataatttaagacagcagtagaatgtcttagtttcaagttacagcatgtaaaagccaaacgggtatcttttactgttgagaatttataccttatactgcagccccaactatttactgccaggatgttttaagtcacctcattgcataacattataaactatgttgccaaacttgactgtatatgcttatctatttagtggttggcaaatacagagacatcacaaaaattaaaagtggtactctttcaactgaaaatagtcaatagacagctagttaactttggaaaagaaatcatattttaaaagtcaggtttagatcttgacgaaattttgtaaaaagtgaatgatttcatacacaccttttacaacgttttcacatgaagacaacgttttataaaagagttgatatatgttctaattccaaagaatctctaaagttctatgaagtaagtctttttattcacagccacaacagtcttagggagcaaaaacacaaatcactttgataaggcacccctctgtagacaagcttactgataaacatgagaacaaatgagctcttgaattctttaacaaacatggaatctgttattcagatttaatggctatatggccaatgcgtttccttaatgtatgggagttcttgacaaggaaagacaactgagcaattaactcagtggaagtcagaaattatgggtgttttgccactttcttggtttccaacaggtgtcaggttattgctgttaacactccaatttgcatctttatagggaacaacctaattgtaaggagaaactcaaagtgccctttcttcaggagttacagttgccttaatggaattccatttagaatacatgcttttacactaagtaaaccacataaatatttaggaagtggggttttgttacctctctgggctaccaaataaaatgtgacttgctgaaaagaagacattaagcacagaaagggacaactctttaagaacttgaatacattcaaaaacccattgcctctattctatcaatagcctcactgcattgggtcacacaacatgaccacttagtggtattcagtctctgtatccctcctgtcctcatttttgtgatgatttggtcccatcagatcctttccaaaccctgagccagccccaacatgaaagaggagggctttatgcagctctaacccaaagctcagaaaccagcactggtttatctctgctattgaagaggctttgaccttatctgtctatctcttttctcattggttgaattctctacacagttttgtcagagactctcacggggtggtatgcgtgcagtttagtatcatcttgggtacagggcttcaagttatataaaaccttggggaactcctatcccaggtcccatgtagctctgttttgacatgactgccttggcaaggaactaatggggatacctctgatgctctcagagtttgggaggataaaaaagatcttgaaccacttgtatataaatcctcttttccaccttcctctctctacattcctattacttataactagccttaggcctaaaatcacacaaactgttcctgacaaatttttctggcacaaattacctgcttgcacaaatccccaaatttcatatacccttggattcttctattccatttagtagcctatttgttagtatattttatcattttatagtaacagtagttatttttgtgccttcactatgtaccaaaaattatactaagtgttttatgggtattatcacatttaagcttcataatatccctgtgggaaaattctctgatgtgataaacctcattttacttatggaaaaaataaattttatgaattggtataatttatccaaagacacagaacagtaaatggtaaagtagtattcacatacaaacaacatggcttcagaaatgaaatctgtgtgttggaatggtttcccttgcctttagtcttcactttctcccttcacctcttcaagttcttcaccttcttcaaggtctcttcattctctaccctgtggccaattatttaatattgttgtgtattgcccacccttcttatcttttggaaagctttggcctcttgcattaatcttctcatcacttgcatatgtgatcttccttttgtgaaaataggaataattctgggtttcagtttgcagttattaacatggctatgccccttagtatgataatttatcctcctaaggtgggtaatgcttagtgtttctagaaagtaatggcagacacatgatagtagcgcagataccagaatagaccagctttcaaaaagatgctagaaagatatattggttccatactgagttttatttgagtattacaaaaggaacccatctatggcttccaatcttccttggaaaattttttgaatggccacagcatatgaatcatcatttgagttgagagtgacaagtcttggacagtagttgtttcaaagcaggttcaatatgtatctgaacaagggatttcatacatacatttgaatgtatttatgtatatgctctcttaccaaaaaaaagacaatgatgacaataaacaatcacatgaaaatgataaaatatatgaaatgacaaaatgacagtaatggagcctttggaagcctgaggttgcacatctcagtaataatttggccaaaggccaggctctgtggctcatgcctgtaatcctaacactttgggaggccgaagcaggcagactacctgagctcaggagttcgaggccagcctgggcaacatgttgaaaccccatgtctactaaaatacaaaaagttagctgggcatggctgcgtgtgcctgtagtcccagctactcgggaggctgaggcaggagaattgcttgaacccgggaggcagaggttgcagtgagccaagatcgcgccactgcactccaagctgggtgacagagtgagatctcgtctccaataaataaataaataaataaataaataacaataataatttggccaaaaagagttaactgtcctttgataatgatcctatctcatggcaggtgtacataaaatagagctgttagcagaataatgagcaacttctggactacatggcttaagagctttttttcctgttgtgaatgatactttaagcaacaaagtcaactatgcattctttctgcaaacaccagtcctttctgaatccatgttatgcttagaaaaataagattataaccatttacacgagagtaaaatggttaatcactgaaaatttaaagcatacatatttaaaatgacacagcaaggatttcagacatagatatcaatatatttctaatgatatgaactacttccttcagctaacctttatttgacattgatattagtttttaattcattaatgttgcacaagaagctgctctgtacataaagattttcccttaggtttttagataaaaataacacctctgtttcacttagcatctttgatgattcacgcacttttattgttagaaaaaataagaaaatcacctatattcacaagattttaaccatggcagtataattcaggggcatatattatcaatcaccacttcgtactgttccattataaaattcaatacatctttctaattctaaaaatagtgtaagctcactgtaaacagttcagataatgcagtaatagggaaagcacaaagcacaaattctctatcatcccatatcccatcactaatttgaattatagtccacaaatctttgtccgtttagctctattcattctaatcaattattttcattttaataaaaaataaagacatatcttcctgaaaaagtttaaaaagttattacatgaactttaaacaccctcttctttttgttccctcatcatatatgtagccactgttagctcattttatgtatcctttctgaaaatttatatatgatctcttttatgtttctttcacacgaatggacagaaatggcacattgttccatttcaagtaatttttgctttgcaatatgtctcagagattgtcagcacaaagccatttcacttttttcagcaaatatatggtattcaaaaatatgaatatgtcaaaatttatatgtagttctatactattggacatttaggaggctttaattttttccttttacaaagtatttatgaatcaatcacccttgtacaaatatctctgtgaacttttacttgtacaggaaatataaccttagacatagacatatcattcaaaatttttattctgtctagtatcctttcagaaatattatctcaataaagaatactactaatagtatatcacttttagttatggttggtggcattgcagctgggactgtctccaaattaatttatattagtgtaagcaatatgttcatatgatttctgtttctccacaatagtaattttgcaaggttggctctaacaagatgaactctgagttcttatgatctaggaataaacaataaagtcagatctactttattgcataactaatccaaaagatacagaaatctgggggctcttagagctttattctggacattatccccaaagttaatgcaactgttggcaattttcccagacctagggttaggaagctcaagaggcatatcagtagacactaaagagtttccaaactacctggcctgccatcttctctaatctccccaacgttcttcactttaagtttgggataactctttatacagcaaatgatgagaatttgtaaagatggggtcactaaacaaatgctgttggatcttgtcaagtcctttgttaaatgaaaaagcagtgtatgctctatgatctctctctaaagttggagtaagcgagagaaaaatctagaaggatatgtgcaaaaatatcaacgttagttatctctagatagtgagatcacaagggtatttaaatattcttcattgtgtttatctttattttgtaatgttttctacaattatatgcactgattttttataataagaaaaaatttaatttaaaaactcacaacctataaaaacccaattagcagcaaagtagaagcagaaatgataactactaaggttgaatggaaataaacaaaggttagtgagtatcatgatgggccatgaatgttaaatgtttccttaatgtagcgaatactaaacgtgggatcttcaggagcccagcacattctcatcagacatacattgcagatgtgaaatatttaggtttatcatagctgtttaactcataagcctaaggatatatacacatctgtcagtaaatttattgatattatttgcttaccttaccatggggtttgtcaacttataacacctctttgacaaaactaatgcataaattaattctagaacaattcttattttcattaatatgtatactgagagggtgaaatttgtatttgctttaacgaacaccaacaacatactaaccactaagaacgaatcatgtggcaagcaccgttctaagttctaagcactttataagatattatctctcatgaacttcacaatcatcataggccatgaatgctactattgtcaccattttgtaataaaaaaagttaataaaaagtaacttacaactttaatttcttattctccgacctagagcctgacagaaagagtgaagtgatatccgtggagaaggcagacatgaaaatatcatagaaacataaataacggtctagattacttatacagccaaacctgaaaaaaaatccctagtcattcatcaatcccttcattcactcaaagaacatttattgtgctcctactggattcaaagtgcagggttaattcgtatgagttataccacgaatttgtgacacagtcctggtctacccaatttattctttaaattttatctaaatattttaaaattcatcttttctgagactttctaaaagaagagaaatagacctaattgaccctatttgaaaataccacattattaataagtattgtaatatgaaattagatgtgaaattagaatgcccgtttaactatcacttaaaataaaggagagacctggctaacacggggaaaccccgtctccactaaaaatacaaaaaattagccgggcttggtggtgggcgcctgtagtcccagctactcgggagactgaggcaggagaatggtgtgaacccgggaggcagagtttgcagtgagccgagattgcgccactgcactccagcctgggcgacagagcgagactctgtctctacaaataaataaataaataaataaataaataaataaataaataaatataaaataaaggagagacttagtctattgcagaaggaaaattaatgctgatgttcacaggatcccttataaatgatttatgtgccttgggttgtccccatgaagcccccagtcactgatatgttgtaagcttgtaagctactgaaatttacttacctctggaaaagaaaatctattttatgttcacttaaaaccccttatcaagtttttcactttgattaatgaaattatgtttcatgctttttcaagtaattacttaattactaaatcagctacaatccaataccattaggaataaaattcaattttagtaactttattggtgtgataaaatctaaaagcatttccagggtcaatatagaaactcctcaggcaggatggcataaattgatagcagtcaaaggaattacagaccacatcctcaactgtggaatgattccattttggatacttagttactgcttttttctcagaagattttctcggagcttttcttcttcttagcttaattttaaaaagttttgttttgttcttttacaggaagaaaatctggaactactgacaatgtaatgattaaaaatgtggagttaaagctcaagaggaatgcaagcatatgcaataacaacgctcacacttaggttagccttcatcggctttcttgtaacttctttatttgttaatgtgaagaaggaaatataattatttatatttttgaatctaaacatagtgtttttctataagggcttaaaaatccagaaactgatgagatcaattgaaattttaaaatcttctagttactacctaggcaaattttccaaatccaaataatttctttaacttcattgtcctaatgtacaagataaaaataattatatattataattataaatacctcaccaacctccacgtaattgtcataaagataaaaatatacgctaaagtcctttttcaagtctaaggaggttttaacttatttatcaaagatttgttgatattaataagcaatttattgaatatttcctatgtaccaggaagcatatctagtaactacacatatgtatgtgtaggtatatatatgcacatatataattcatttaatacacaaaataaacatgaggttggccttaatatcagcatttcacaagtgagaaagtagtttaagaggcttagaattttgcctaataaatgcaactcataaatggtataattcaacaccaggcttaccgagctatctgatattctatgctagggtgccagttgctttgaaacccaaaagaatctgaatttagacagctggagagaagttgtaattgttatctgaacacattttttaaacagcactataaaaatcctaattatctttgcaaatataagatggaagtatgaattattttttttttcctggaagctgccacgatggatgtcttgattaatatttcctaaagaaaatggaatgtatggttaccacattgtgtcaacattgttgtgttattttagaaatgtattgacttgggagtggccagtgtctcaacctctgtttctctacagttttctcggctttgcttgtctccagtatctagttaggatcagaggcatttttcatacaaggctaaaaagacaaaagcagtaattacagattcacatccaaaccccatgatatccagaagaagtcagggagtaataagcatcctttagtaagagcaaggaaatttcttttccaaaagaattggaaatttttccctcactacatttcggccctcaatgtacaatgccagattcctgacccaattcctatctttagggcgctaatggtcccaagcctgagttcctgaatcaatcactctgccaaagagaaagggatttcctttagaacaattgttctgctctccttaggcagagcaacatgaatctgctcataatgaaccctgtcagactcctgggttcacacctagctttcccacatacttaagtcccttaatctcttcatgttttgctcccacgtgtaaaaagtgaggataataacagcgtctgcctgataaggtggtggtaggcattaaagaagttaatattcataaaaatgtttttaaaatgcctcacacataaaataagtgttacttaggtcttaaataaacccatgaaatctacttgaatagtgagaaacacagcattgccacagtggcctaaaacttctcaaccacacatcttttgttttagagtctctatgcaaatgtcccttttaatgtctattttcacttcattaatgtttctaccacactcctcaaacacacggtgaaatcagcaccatggtttgtctacttctcatggtgctggattctttcacgcctctaaatagttctacatatctatctccttgtatttctatacctttataatatgagaaggagttaggccaccctgttttgacacctgcacaactctttattataaccccagtacttgttaatattcttcccagtgtgtacatctatgccttgttgtcaatattctgtcaagattttgaccacaggtggggatgatctaacctatttttcccctatctttgtccatctgcttttactccagttgttatagttctgatttgaaaagtgctatttgaattagagcatcctaaaatattttatttatttattttttatttcttttagagacagcgtcttgctctgtcacccaggctggagttcagtggtgcaatcatggctcactgcagcctcgaacttccaggctcatgtgattctccttagcctcccaagtaggtagcactacaggtatgcccaccacgcccagataatttttaaattttttgtaaagacagggtcccactgtgttgctcaggctggtcttgaactcctggactcaagcaatcctcccaccttggcctccaaaagtgctgggatcacaggcttaatatcacaccaggccctaatatattttaatatcatttttactttcaacatttaacctctctatggtcactatttcccagtaacattctagaccaattttcacaaatattgagatgattttaagtagttgaaaaaatgctttatgtatttctttcactattcatcagaaaaaataaaaccagcatatgaaatctattttaaggatattattgctaatttcattttagtaaaatgtggaataatttttttaatgttagtttttacttaaaatggtggtaaatggacatagaaaaaattctggctatcagaacaaatgactgatttttggaaacaccaaaaacagtgataactacacacatacacacacacacagacacacacagacacacatacacatacagacacacacagacacacacacacacaaagagagaaagaccttcagagcacagtagtaatcagagaggtaataataaagaattcattgcattttatagcaatttaattcttttagtgtatgctcataaatgtatatgttactgccagtctcgcaaaataaccctttagtttagtataagatatactcataaaatttcagagacaaaaaggaccccagagactgtattcttcatgaattctttgctctttaaatgtttaaaaggaggtctagaaatgtaatgacaagtcacacagccaggtggcggcacatttttggattggaatcttaatctccagatccccaaatcagtgtttgttagtttgttggtgtttttactgtaccaaaccacctactccatagttattcttctgttaagcgtggaaaaaactgtggctctagtgctaaggcaagactagaaaccagtttcaatgagtcaagccccatactatttctcctatctgctaagccacaaatatgagagtgtcacaaaatccattttcctacaatcatatagtagaacatgattattgtcaaatgtgcaaaataattatcacaaatatcttgtaccagtttttgatgtcttacctaagccactcttatttaaaatagtttgttcttttagcagcacaagaaggaaattagaggtagctatataaaatgtattaacattcccttagcaatcaatctcaattatgtataagttatcatgtgttggtctcatttacaaactgaatttctactgactatttttctcttatttccaactgaattggttttagtgtgggatatctgtgctagatcttaaaagaactctctgggagttctttagctttattcttaaggcaagcgaaagaggtgataatctagaatacttgcagctcaaataagtgattaaagaagcatcattattcacagacagtggatatgaaaggattgcaacaagtaggcaaccatattaactgagtccctagagggaggaagtggatgattttgacaaatgcatgctccaaaacaaagacctgataggtaaaatgcaaaagtaattgttgagcatcaacatttttcttgtcacatagatctattaacactagttcagggtctcattatggaaagactgaactgctttttattcactggatttatacatttgctgcagggagattttctagtttacatttttcattgcatgactattcagtaaatattctgcttgtgttgctgggatctctcttacagtcctgagtcttgcaaagccaccctggagtcatccactgttttccttcctacacacctttctgggtctttttgggctgctctttgccatctcatcctatcttatctcattcttttgttggctgcttattcacatacatttgtatgtagaacttcagttttcttaaaattacacagaaaatccccaaatgagaaatatggtcctcttgctgcaatccagttttagaagattggtgtgagagtgtgcctaaatttatagtcagatgaattttttaaaatatttacattttttagatgattgtaaattttgaacacaaattcaagatgtgctttcagaattgtcagctctggttaactttctccatatacagtacttaatctctaactattctgtaattgcttttctgtaacttttaatcgtttccttcataatcttactcaagcatttgctttttgatctgtttatttagattaccaatgtctttattttctcttgccattgctttgattatatacttattttttttaattgagatggagtcttgctctgtcacccaagctggagtgtagtggcgtgatcttggctcactgcaacctctccctccctggtttaagcaattctcctgcctcagactctggagtagctggaattacaggtgcacaccaccacgctcggctaaatttttttttttatttttagtagagatggggtttcaccatgttggccaggctggtctcaaactcctgacctcgcgatccacccgcctaggcctcccaaagtgctgggattacaggcttgagacaacacgcctgccgatgatatacttactttttgactttatgttcatgtcaagtatttttagttatatatagcacactcaaagaataaataaactacatcaggcatcttttaaccatttaaacttttcaaacatattacgcataataatcactacattgttattctgtaatcttagccccttaacaccagtagtctataaaatgctacttattacataaagtaaaccattttaaaagttaaaaagctgatgtcaccttttgcttaaacattttaattattggctgcaatgaatggaatgtttacatccccccaagattcatatgttgaaattttaacccccaaggcgatggtattaagaggtggggcttttaggctgtgattagtgtccttataacagagaccccagaaacttccttgccctctctgctacgtgaggttataccgagaagagagccgatctctgaggaagcagaccctcacagacacaaaatctgcggacaccttgatcttggacttccagcctccagtactgtgaaaaataaatttctgttttctaataagccacccagtctatattattttgttacagcagcccaaataagatattgattatttgctattttatattatattaagaactgcatttatttgtaaaaatcttgccatttgcctacttgtgtagctacaccagttgttaagatcagtatttgaaatatactgtttactgcctaacatttataagacataattcagtatgagtgccataacttttcattgattcattcactcaacatatattttaagaacctacctttgcttcacatagtgaaataccaacttatcatagacatatattttaaatttatatcatttacacaggggctttgtaaaatatttttctcaaaaaattgagctaataaaaatcaaatcaaaattgatttttttaatgtagaaatccttttcaatacaggaaataaacccctttttttgaaagttaatacgcatgataatgtaattattggaaattatgaaggtccttttaccgtagtataccccaacatacaatccctgaagattcaaccttttaatttctccatccatgtcactggaaatctaataaaacctgtttgtgtgtaccatattttccccaaataactcaaagtggttatgtaaatatctttttttaagtcacagctcatatcaatcacgtagtctagtctgttgtctctattttataaatggaaagttagacgcaaacagacaaaaaggcaaatgtctaagcaagattttaaggatgagtaagagtttatgtatgaaccaacagtagatggaagagtagagcatttcaaacaacatatggaaaagaatgaaagcataacattacagactgtctattcctctcttgtgtttcactgtatatttcattcattcctccaaattacgtcatctgtaactaaatatagcagatgaacttgaacatacatagagagaatttttttttgtttttccagcatcaaacctggcatgaagtaagagactcaaaaattatttgggcttctacagaatcagatgagtaaatacttcctcaaactaccacattatatggtaatagctaaaaactctgatttctgatcttctcattttcattcttgcaacacaaatcagcatgttgaggacctaccacgtgcccaatattatatcaggtatagaaaaaatgtctgacatgcccccatattgaagaaaggaaataataacatatttcgtgtgggtccactgttacttcttagattctaacgtaatcttgagaagaacaaacttttctccatgtaatgaaaaagaatagtgcagattgccaatgcataacacatttaccctgctgaattgcccttgcttaggtaaatgtggatgtgctgactcctctcccagaggaccaagtattccccatcctgactcctcctgttctctttgatatttctgacatggagtggctaaagattgtccctactcatgtttcctgctgttcttgagatcacacaaaggagagtgtggtataatttaagggatacaggctttaggagccatatcaatattttttcaccaccccctcccctagatttactacttttagccttgttaccttggtaaaatccttctatgcctcaatttcctttccattcttaaattagtagacttaaataggataccatgataatgcctgtaaagtaactggtacaattcctagtgtacaataggtatcaatggctgtaaatttcctacctcccttatcctttttcatgaaagaaaatttattcgaaggctgccatattataaaggtcattaagtccaactccctccaggaagcaggaataattcaaatatatgtgggtaatcacatcaaagtagtgtcttaactattagtaagcccaatcaataaaaataaatcctgtactctcctagagaagttttctcaacatcccagtgacatgctaaaaactgtttacttatatttacttatgggagtcctgccatctagattagcataaatactgtaatctgcattctacatatacatttttggtttgtacacaatagtacttaccaagattgtaatcactgtatttgctaaacccaaaatagctgaagctttatgaacagattatgctatgatgtacatatcttaaaactattccattttaatttgtagacaaagctattatttactttgaataataatactttgctgtttgttaccttgcctctcaggttctaatttggatggatgccttggtctaaaaaagagctttgccctttgctatcactcttccttgtcctctccttactaccgtgacccacttctcagagtgaaatcatagggcagaagcttcgataagatatttcttccgccctctctgctgacactttccctttcccagcttccattccaaaattgtttgatcattttactgctgcacattctctccagacacccaggaattctgtactaaaataagcattcctttattgccaatggactgatacacccagtacttaatccctggggtctctttgccgctatttaatgtaccactgctcatgaattgatgctgtccagttttcacagaagactgaaaactgaacatttcctttgctttatggtgcttgacactttggccacatttgcttttcactcttctcacatgacttgtatcaccaaagggcaatggctgagtaagagaggcaaaatgtaatgtttctacatctttgctttctataaaatgcctagcaaagaattgtttccttgtgatgccccaggaatcatatccctcattgcccttcccttctctttaactttactgagtagaaatgagtgtcatttagaataggggtgcccatcccccaggccatgactggtactgccttcagtttcatctccttgaaattgatataatttaatcagatcatgatctctagaagcattcattcaatggtgactattttactagtatattctaatgatccagcatgtctacagtgttttctgtacaattactctacctgtatgtatgtttttcttatcagacagtattcttatggctattaagtatgatgttgcctttacttctttcttgtgagccactatctgtgaatatattttttaaaatcacgttttcatcccacgactgtcggcactgcactgtggttaagaatgtgagccctggaattctgtctttgtcatagactagttttgtaagtttggaaaaatcactgaagatctataatttggtgatcacttctgtaaaggagaaaaacctaggccaggggtggtggttcacgcttgaaatctcaacactttggaaagctgacacagtaggatggcttgagcccaggagttctgggcaacatggtgagactctatctctacaaaaaatttaaaaaaatagctaggcgtggtggtgcatgcccatagtcccatctacacaggaggatgagggcttaggtaggaggattgcttgagcccatgagtttgaagctacagtgaatgaagatcaccccctgcactccagcctgggcaacaaagcaagactctgtcaaaaaaaaaaaaaaaaaaaaaaaggaaataaaaaccttggcatctaattcacaggatcattgtgaaaattaaataagttaatgtttgcaaagccctgagaacagtggttggcacatattaaatgttcaataaatgaccattattattatcaactacaagtattccatgacctatttaaggaatcttataagttttctgaagtctaatgcattctctttttcttaccagtttgttctcattcaattctatttcttacctttactgtgatcaacagaattcaaaacatgactttcataatttctgatattttattcataggctactgtctaaatcagtttaaagtagaataataatttgactacaaatggagaaatgtgggttctatcatgtctgacatcacttcaagcccaaacacattattcatttaccttttgaatgccttttgcaacccacattccctttcagtaatgggcactccactatagtgcattttagatcttgtttaaatctgactcatgtttccatcttatcctaatgccataatccacatgaaacactcagcaaagtatctaatcagtgcttaaaaatgttagctgttaatatggtttgtgggtgacatctgtgatcacagtgtggaaatggcaagtacacattttttctttttctgcatgggcagttgtgtgtatactcttgactccagcttgttctcttctgattatgacaaccagatgctctctaatctaatcctggctctgctaataataaactataaccccaggcagtccaaatacttattttaaattatgagatatttgaagagtgaaaagaagtatgaagaatagtataatgaacacctatgtatctaccacctaactgccagatttcagcatattcaacttttatttcactttttttttttttttttttttttttgaggtggagtctcactctgtcacctggactggaataaatgcagtggtgcgatctcggctcgctgcaacctctgcctcccggattcaagtgattctgctgcctcagcctctgaagtagctgggattacaggtgccggccactacacccagctaattttttttttttcatttttagtagagatggggtttcaccatgttggccaggctggtctcgaactcctgagctcgtgatttgtccacctcagcctcccaaagtgctgggattacaggcgtgagccaccgtgcccggcctcatattttttaaagaaacaaaacattaaagatacagttgtaagtctctgtgtgcccctcttttattacattcttttctcttgcaccctcttcagaagccactaatacaatttttatatttataatatgaatgcatgatttgtacttttaaaacaatctagaggtctactttactctctaaattttacatatgttatcaactttccttctatatgttgctttgtttcctgaaacagtgtttttgaaatttatccgttttacccagaaaacttcaattcatacactttagttgctttatagcattttattgtataaatctaccataatttatttcttcattctcctgtttacagatatttgggattgaagtttttcctgttttttgcaattacattttaatatatttttccttgtaccctgtgcaaaaatttattttggatatgtacctacagataaagtagctgcatgaaatgatgtgtatttactaaactattctcaaattgtttttcaagcagtggtatctacttatattcccaccaccagtgggttaaagtctctactgcttatatcccagctttttattatctgtgaatcaatgagtatagtatcatatcaatgcattgttttagcttgcatttctctgatttctgttcagctttcttttttttactttgaggaaggtgaaatatgtagttaagtatataatattaatattcagtaactgttatttctttttcagtctgtttcacacactttttgaaaaactagtacagagagatcacattttatcattcgatttgttcttgaaattacctgatcaaatgttacgtaggaaatataaaagggtataaataaaatgcatctatttctttttttttttaaccaacgttactgtgaaagaaggtaagctggtaaagtttatattgggctgatgtgttcagtattcatatataggagcagatatagagcataagaaacatataaaagagctgactataaatgtccactaagcaaggctacggtttattcccaattgtgccatcccatattggtatttaatagatggctgttgatgatacaataatcataacatcatggtgataatcattataataattataagatcagttaactattcatgtttagttaggttcagaaactgctgtgattatggttgactgctgtctttttaaaagcacaattttcttcaccctaacttcaattttttccataagaacaaaactaggataactctggatttgctgaggtatctttaaagtcttctatttttgaagcaaagtgtgactctaggttttccttcagaggccattttaaatgaaaccagtctacagcttaaaaaccttcagtggtgcaacactgagtttgcaacaatcatctcaattatttagaacagcacacaaatccctgtccacatttctaaccatattgaacacgactacttataattcacaaatcttcctcaatctctcattatcactgggcaccacagtgcattatcccttctggaaaaaagtaatgttttacatatattccttgtgtcctagcatatattcctagttttctttctactcctctgtaagcttttttgtttgttttgtttgcccaccaggtatcttaagtcatatgtctctatgagatcacaagtttactatgttcaaaattgaacataagctccctcaaaccaccccgcaaaacttttcagtgaaaagcacaccactcatccagctgtacaggaccaggtagaggagccccttcctctcattcccagagttcaatctatcaccaaatccttttcatattctacctcctaaaacatcctggtacctattcacttccttccacctccattctcaacaccatcatcgcacctcacatctttacttcagatgctccctttgccaagaatccccaccctcattattattcattttctccccaggtctgtttaatatacatgtctgtgatttgtcacattcattagccatttgggttgtttaatttgtctatttttaaaacaaaatgcattgtcaatatttgtaaatattctgtatgtatatgtttattctacttttagctccttttagtctttatctcttcattgtgaagtgacctttccaagtcccagttgtcttctttggcactcatgagtggtgcagcaatgcctcccagaagccccatgacatttctcctacggcatggctactatacccatgcacttgtcctatttactggtcccctgtgcctccagaccatgaaattgttaaggacaaaggcccattcttcctgactttatcaccagcacctagcatgctacacaggccatcatcactgtccaaaaaatctcggctgcaataattggttataatcaatctcatgatattgatatttccaaggaaactagtggtagggttacatgattacttttctgtttttgttgcttttgactaagtaatgtttctgcttgaaataatgataatgttaatttccaaaaatctgtaaatccttttgtcctaacctcataattaaaagtgatgcagtaaaaacaaaagatctgaggaattcaaagaccaaagatcatacttggaaatagaccctgcagcaaactgctggaaagctatctttgttttcagtataaaaaagaaaattctatcccattacttcttaaaatgcattttttttatttgtagttaagtaacattcagcatacagaaaacaatggggaaaatctataaaaactatcattttcagtgacattctgtgaccagagaatgctctgtgatgggttgaagtttagtttaacaaacaaaacaaacatctgtcacaagaagtcagtacctacaagagtgtttctaaaggcatgtgtaagttattctgtgttaaatagcactatgattatatttgaaccatatacgtaaatatgcataacagtaaatttgaatgttcttgaataagtgggccccttttaagtgtcaaaaaaatcatgaacacttacataacctgaattgcactattaatattcattgattctaaggaaaagcttactgataaaatgctatcattaattaagtaaagtacatttaaattttctaattccaacagaaataggtgtgtatgcaaatccatattacatatgtttgtgtgaatgatatttatctagccttcaaatgctactttgcctacatattgatttgctaatctgaagccagttgggagctacagtatctcatatttaagaagcattactagttagaaagcaggaaccatgtcttagagggttttgcattctcatgcgtagcacggtgtctggcacgtataatagcaatagatatgcaataaatgcccagatgagtaaaccaaaacactttgtctgtaggatattataaaattaatgttgttcatacttaagtgagacaaaatatattcatgaaagaaaaccataataaaaagattatcttatgtcagacttgggcttctaggttcctgaaaataaattcacatgtagttactaatatgtttggtcacacttggcatgcattgctgcactttcagtgatagtggctgctttagccatggatttgatgaagggaagggatgggctgtggaacgcctcagatagaaagttcttacagagaaagtgtcatggtgactattctgtcagtggcaggagggatccagtggcactgattaatatcagtgccagtgctttatatggaaatggggaaacacgcagagcacagaactgaaattatattatacgtgtagttccttttgcctgtttgaacattattgctggcggccagaatctcaacctatataattccatgggaatttttttcatggattcacccaagatgaaactcttgtcctgtatctttaaatttttgctttagctctaggcttacagtgaactctgtagtcaggctgcataaatattcctgagctttggctttctgcaccaaactctcctgagaatagcataggcagtagattgcagttaaggattttttaaatgttttaattttgtgatagcatgcattttcacaaaaaccaatgtgtgctttagcttgctacactctccccattctatatatttagagggaagagagtagggagtcatagagcctgtcgttattttaaaagaaaaagccatagatgtccacgtgaaagagcagaagatttattaatggaaaatgaaataaataaaatactctctaaagtataaaaagactattcagcaataaatcttgcagtacaggctgatatgcagtgcttaaggtcttatcaagcctatactgaaggaattcagtagacagttacactatgaatcaagacaatatatttagcatatactctgcgtttgcttgcttttttattttgttaaactttcgccaggctttgaccacattacatatttagttggagtctttatataagggagccatgattttactttttgtatactttataacttattaggtaaaatggggcaatagaataaatagaataatgcagggtttatttgttctttctgaaggttttggatacaattatttctcatggtttttcttttgccctcataaaataaggctctgcacctcaggttggaatcaattaggctgatcctcagctgttcagcattcaaggttcccagtggggcagcctgtatgtacctgctctccccactgaggttttaagctgaacttctggaattgtgcccagtctttgggccagacacagtatctcagcaatgctagtgcagaagtctagtaggtaaaaacctctttcatggtttagataaaaatctattggtgctcttctaaaaacaatcctctacctgaaatgcttgtaaccagaaaataacactggcaattagagaggaagacagccacataatgggagatgcagagactctgggttggtgattatttatataatattgttgaatggtataatagatgcatacgttctattgagctaaagctgtatttatccacttgccttattttcataaagaatatatagtaatctaatttctaaagaaaaatgtgctatgtggattctttatacaagaatgagagcttatttttggatgtaataagaaatgtgaaattattattattaagaaagtaagatgtgggtatttctcttccaaaggtgttggtcttctctgcagcatatctccagatcatcgtcagcaggactgagttgaacaaattgaagaaaacaacagtattgcttttcagattctgaataatttgcaatattaaatttgtagatcaaatcagcatttaaatatctgtcaaaatgattgctaatacaatttggaattcaggttgaattttgaaattaatgaaactacacaagcttaatgaacattagggattaaaatgcaagaatttctgtactatggaaggacacatgcacaggcctgctttttacaagatcacagggggaaatgaagggaattcttgaaatcaaaaacgctgctaaatacaaatgtcaaatcttagtcatcttcttacttgaccaatgagcagcattagacagagttgaatgctgtctactctgtgaaacattttctttacttggtttccaatacacattttctttgatttccctcctccttctctagccattccttcttagcgggctcttcctcttcctctctaactcttaattttagagtgctccagggctcagtccctggacctcttgtcttttctatctatactcattccctttgtaacttcaaatagtcttcttggctttaaataccatccacagactgaagactctaacatttttgctatatcccctaaaaaccccagatttatactcacgaactcacttggatgactaatctgcatctcaaatttaacatgtccacactcctgataatttccccagacctacttttcccgttgtctttctcatctcagttaacgtcaacttcattcttccagtggcttgggccaaaacccttagaggcattcatgactcatcactttctctcatacccacatcctctctgtgggcagtttatgttgcctttacctttaaaatacatccagaatgtgaccatttctcacccctacacttctaacacccgagttcaatccataatcctcttttgcctgggtgactgcaataacctcatttctttgcttttatttttgatgttttcactatcttctcaacatgcagcaagagtgattttgttaaaaaatgtcaggttatgcttcccctttggttaaaattctcattgtgatgatgaaattctaaaatttagcagggagtataatgcaggccctgaccaactgaaattcatgctaacatccacctactaagattggaccaatacctaccaagtaaatatcaactgtactcagagggcttcacatcgtcctgtcacctcgggatatttccatctaaacactttcctctgtttggaatgcttttgctccaagcaagagtctcatcttccttaagtctttactaagaaattatcttctcagaaagctttcccctgactactcaacttaaaattgcaggtcttcctgaccccaaatcctggccttccttaggaacactgatcaccaaatgtcatactacacattttacataaatatcttgtttattgtctctcttccccactataatgaatccccacaagaatagactttttttttttactcctatacccatcacttagaacaaggtctacataaaataagtgctcgagaatacttgttgaattaaagttgaataaataaatgaacaaatgaaagcaacgtatagtgtggagctaagaaacgcagctcaaagcttggggattgtaactgtacctgtcttatcctagaatggcacatttaaaaaatgtttttgtttttgttatttctaggtgaactgctaaattcaatagtttccatctagatttctaaatggagctgggaatatataaacaaacaaacaaataaataagtagagtaagtctacaatgtgagtttggctttttagtgttaataatgttacacatttaacattccgtgacattatctaaataaacttacttaaactcacccaataacaataagagtgtttgtttaacttttccttcccttaaattagcaaaacagcttaatcagggtaacaaagagctgcttgagttttatatactgtgccttcttcccagaacttactatttcccagctcctccatgaggagagattttacctctgagttcttattatttccattttctcttaacgagctctttctgctcagcattgataaatgctcaaatcatcacaaacacttcctcccttatgactccttcagtcacttcactgcttgcaagttgtagtctgtccccaattcctcacctaaaaaggaacacccagagccccttggttgtgaatctagtgggtattccttggtctttatcctacctgactttccgtcaacaactgagatgactaacatctgattcttaggacactttccttattgatagcattcattcatttatctccttccattcctttgactaacctctctgggtattctttctcacattatttgtttatcagaaatgaatacgcttactgaagttttttctaataaggtcagatacttccaacttttaagttaagaaattgtttaagcactaaaatatgttaatgaaatgaaaacattaataaattagttctatacttccacagacatattctgactataaatcttaagtaatttcattttaatatcccactgcctaatgaaaagaattaagcacatacacttcctaacttctaagtaacagattgtggaggatgctttaatgggaccctcagatcctccttcaggaacaaaacattaatttccccagccacaagtgttggatcctgaaagctcacaagttagtacctccctactcattctcctgcccaataaaactacctcatctgcatgtcttccctgaggacagccatatccaaggactgcttgatgctggggtgaaaaagcacaacccccttgtctcaatgccagacaatgtggaagagccatgctagcttcagagctccccatgacactatctgagagctcttttacaaccaccactcagtaagcctccccgtcttcccagtgctgctgcccttactccctctaagagctcttcttgcacatcaatctccatttcagactctggtgcctgggaaattccatctagacatacgtcatctctaatacttgagatactgagtgtctgtgctaccgaacgttggcagaatatgccacctcaaaattagccactttggcataaggcatttcaaaaatagcaggaaaaaaagagtctgaccttctttctcctccctgtaccaggaagaaagaaatatttttcttaccagagatggtgagtcaaggctgaaaagtatctgtaccaacagatcttataaaaataatttttatcttccttagctatcccatacatattagttacttatccactatcaccagactttgttcaacctaatgtataaacatctgggttttgccacttctttcggtcttcattttcttgtggagatttctaggtgcatgtaaaataaactctacgattttctcctattaatctgccttatgtcaatctagtctcaaacctagccaaagatcctaagagtgcagaggtagagctttgccttccctacttcatttcaagtggctcagtttcaacccttgaacagaatgccactgaacatttgtgatttcagctttagtctcactgcaacatttaaactaaaaatattctctactaagccagagaagttggtcacattataatctccttgataacctgctttaaaatttcaatatgtagtactagaaaaaaatgcaaggtagtgcctgcccaacagtgagtttagttgacagaatcaagcaagttactcgtagctgcttgtcaaattgaaccaaactaaagtgagaaaagagctgataggtttagagtcaggtaaatcaattaaggcttaccatttctccttactaaattgattttcatgatcggcacgagaatgtcagccaaatgatattaggacatttaattttattttagctatatttacacacacatgaatgcacaaccggtttgcctgaatataaagaacacttgaatcagggaacaatcgcactttttaagacagaggttatcagattgaattttttgaaaatataggtatatatccttttaaaaaggtacactaaaaacaaaacaaccctgaaaggtgggaaataatatgacggtgtgtgtgccaaaacatttaacttaaagaaaagcaatgtaaataacaaaccgaatagaattttagacaaaaattgatacaaagattataagagataggtgactaaccaccaggaagtgagaacattcattatcatgtatgtgtgtgtatatatctatctatatctatatatctatatatatatctatctatatagatatatctatatatctatctatgtagatctatctatatatctatatagatctatctatatagatatatctatatatctatatatctatatatcatatacagatatatacacacacatatatatacacacacatatatatacacacacatatatatatatatacctacaggccctggatatatagaaagtaataactttaacaaaagtatagcagacaatatacagagcatcaaattatatttttgtagctccaactccaacatataaaagcacatttgccattgatatacccagatacattaaaaaagaaaaaaaactcagtgctacatctctactgcccaatacagtagcactagccacaagtggctatataaacttaaagttaaattttatttaacttaaagttaaataaaattacaattacaaattcagtgaaagtaaatttctgtttttttgtttgttttgtttttttagccaccctgtctgtggtactttgtcactgcagctccagccaaataacacatcaggtttgatatatttttacaccatactctctttcatacctgcttactaacaataattggaaatatcaataacactgatgattttttttaaatcacaaaattatgacattcaaaatttagaggttgttttctgaataagatattaaaaggcactcagaatttcagaacccatctcatgctgaataagacatagtgtcccggagccaggaaagcattcactttttataaatgcacttttgtttagttctctcagctgtgcacagaagaaacaggacagagaattgcacagatttgtgcagcatattatccaaccaacagcaatgatacaaactctcaatggcagaagagatattatgagtgtttattgttaatgtttgaaaataaaaagtggtaatgctataattatatcctatttttttaagatttgaatatatcctaccattaaaatatttggttctcatgctatatacttttctttatttcacagactaaggaatttatcagataccagaaactcatgggtatattgaataagcccagagttattgctaatgtgagaaacacactcacccacccaaacccaaagatggacttagaagcaaaaagaacagcgaaagtgagacttttaataacagccttgcaagatcgagtgtctggtaggcaggcacatctggggcagtcacaacaggtaatttatctcctagcacgcaagtccctcccctagttcctcattggtcgagtactatggggttacaatcttcccagacgttgcctaaagtttcattatctcccttataaggttatacctccatccccttccttgcttaagtttcgacttcccaaaaatgaaactttcttcccttttatgggctgacccctccgctacattctgtttgcttattgtgaccttctaggtgcaagagccctgtggtttgttacatttgcagcctggctgccagtacttagatttatcatgccttgaaaatggaccatttaaaatgttttctcacactaacaacacaatcaaagccgttgatatatttctttaacaaacacgagcaatttacaaagttaattaatttaattttcctaaaaagcttatgaataaacactattattacccaattttaaagttgggtaacgtaagatggcagagaggttgaataacttcctgaaagacactgggggcacagcctcagtttgaatccaagctgctgcctttggagtctgtgctcttaaccactgtgctacagcttaacctgcgagtagctctgctaactcttgttttcaagcgtagacttacccatgtagaggcaaacatagggaaaaatgaatcgtgtcaagttccatccgcatgtgtcccagttaaatgtctacattaaggtaaattaaagctggcaaatctacagtatttagggatacattttcaggttgtaatgtggtaaaacaagcaagaaagtgattaatataaaaataaatacagtattttgctttgccagctgtgggaggctgggggaggggggattgtggctagaaaagagtactacacagaatgtatctggattaagactgtttttttttttttgaccaaatgatgttatatgagttttctcttgaaaacaattcaatacgatgtatgtttgttttattcacttttctgtttatatgtaatttcttgcaacaaaagtcttaatacatttatatagacatacaaatacatattttaggtttgttggaaacagaacaatattatatatcccatttgcaaatgtttatataaaatacatgaagtatggcagcatccaaaaaagtaagtcaaacttacatactgtaaaattgcagattccccttcattattgcatataccataatgaccataaattaagtcatcatcggccgggtgcggtggctcacgcctgtaatcccagcacttcaggaggccgagacgggtggatcacgaggtcaggagatcgagaccatcctggctaacatggtgaaaccccgtctctactaaaaaaatagaaaaaattagccaggcattgtggcgggcacctgtagtcccagctactcgggaggctgacgcaggagaatggcatgaacccgggaggtggagctttcagtgagctgagatcattccactgcactccagcctgggtgacagagcgagactctgtctcaaaaaaaaaaaaaaaaaaaaaaaaaattaagtcatcatccagatggaaatgctgtgaaaagtttcaactagccagatatactagacaaatattcataagaaataaaacattttgaatacttattaacaaattttagttttttggcagatgtagtcatatatatgtgcatacatatatacatatatacatacatgtttatcacactcaagaattataccaattaaagggattctttatatttaaaaaataataattataaaccaaaattgattcatattgttggaaaacattataaagagttatgtagattgcacagttaggaaataaattggccaacatttactagttaatctttattaagaacttactgagtgtcaggtgctgtggtaacacattatgtgcattacgtttgtaaatcccaacaatgaattaagcagccttatgattctcatctcacagaatctagaggtaagtaacttgcccaagttacactgctggtaagaagccctacttcatcaacaacaactacacttgaaacaatagcaaaattgaagtgtgacagtaaactgaatgcaatatacattacagtataatttattttattacttacacatttcagcaaagtgcaagttttctggagtatttatcttgttcccatagatgttgtacagggaattcaataataagaatagtagccagaaaagaaaaaggcagaaaacttaacagttataagaaaatgaaaaattttagtacttttttctattcccatgctatatatcataatatagaggaaattaaagaaaaatatttttgattacataacttttaaaaataataattctgtaggtgtgaatatgtgtgtgttaacctgtatgagtgattaatatgtcattagaagaaaggatgttacccactctaaaataatgttagatgacatttatgcactaataatatgaaccacaaaaaaagtctaaaatatttcagacaatggtacttatacttaaaaatgaatttatcaatattaccaaagcaacaggaaagtctatcatcataacagtggagtattaatacccatgataaaaattaactaaattaaattatatttagatattttttgaatattcaacaagaattaatttgtaaatgagtaacaggcaaacttactgacttttcctaaatataatgactgacttctgagagctaatcagagttcactgcttcatttcaaaaatagcagagtaataatatataatattaatttaaacatattactcttaaaaaacataactacaagattttcctaaacaacttgcaacttaataatgcatactgatattaattgcaattgtttatatacaaaaacttgggttgaattctctctctgtgttgcttaactgttatacacacaccatttgctatgttttaatggaagcattttgaatacccaaagacatgtttttaattgatgaacagtgactcaggttgtcagcaatcatataggaaggaaattataggttattacaggcatgtgacagaagttaccatatttttccttcagagtttggttctaacactttgtattttggccaaatttgtagttactttaccttttctagctttgatttctgcattggcaaaatggggataattagagttactatctctatttgttgttataaagataattgtatactacacaaaagcaacaaactttgtatctgacacatagtaggtgatttgtacacatcagttacctacttttttctaactctaagaaggcttaggttgttacagaaaagttactaaagtctttccctctttcctctccccagggaacccctctttctttcctgttctatgtagtacttggagctccaggcagagaagttcaacttgctaagtaggtgccttattactgttgtatcaacattcaattttagataggtattttaatgattttgtaagtaaaagttatattctagaataaatcagttctattctgcatttcccacaggatctaggagagtggcacatactcagcaaatattaaatacatatttggaaattaaaatgaaactaactaaatcttccatctaaaatgcacaagatatttattactcattttgagaaaatatgtttttaagctgatcaaactagtatacaagttattctttatgctacctaaatttaaaacagaagagaagttcaggttgatgttttataccaagctaaacttgtgtacaactaaaggaaactggtgcagaagctctttagtttaattagatcccatctgtcaatttttgatttgtttcaattgtttttggcaacttcatcataaaatctctgccatgcctatgtcctgaatggtattgcttagagcaaaagaagccatcattagagtgatcagacaagctacagaatgggagaaaatttttacaatctacccatctgacaaaggtctattatccagaatctacaaggaacttaagcaaatttttaagaaaaaaaaccaaacaggtcaggttcgctggctcacgcctgcaatcccagcactttgggaggctgagacgggcggatcacgaggtcaggagatcgagaccatcctggctaatatggtgaaaccccgtctccactaaatatacaaaaaattagctgggtatggaagggggtgccaatagtcccagctactcaggaggctgaggcaggagaatggtgtgaacccaggaggcaaagcttgcagtgagccgagattacaccactgcactccagcctgggcgacagagcaagactccgaaaaaaaaaaaaaaaaaaaagacaccattaaaaagtgggtagaggacataaacagacacttttctaaagaggacatatatgcgaccaacaaacatggaaaaaagcttaacatcactgatcatcagagaaatgcaaatcaaaaccacaatgatatatgatctcatgccagtcagaatgacaattataaaaaatttcaagaaacaacagatgctgatgaggtttcagagaaataggaatgcttttacactgttggtgggaattagttcaaccattgtggaaaacagtgcagcaattcttcaaagatttagaaccagaaataccatttcttggggtgaacagacccaacatcaggtcgtgggggtgacgaattccggcagagtcaaaggaatgagaaaaagtcagtttgagagagaaaagtgggtccaggggaccatcgggagtttatggaggctgaggaggctgagaagcccccgagctctgggagcccatgctatttattggtaatccaacaaagaaacaggtggtgagaatgtgggaatcaaaagggcctgttgcattaaggacatgatttacagctgtgatggtttagcagtttctctgctacttgagataatggagagcaggttcttttaactcaagatacagtcgatcctgggagagcaagaaacaaggagccagcaagtctagacacattccagagccacgagccctggattctatccaagccactacagattttatgccctgggcttagattatggtgcatcagggtagccttccaccctttaacacagagcttggtgttcccaaagccctcaaggggttttagaccccggaccccagacatgttccaagactcttttacattatgtcagacatgcaagccctgcctcagcttctcccaacactcagctttttccaacaccatttgaaccagcaatcccattactgagtacatacccaaaggagtataaatcattctattataaagatacatgcacgcgtgtattccttgcagcactattcacaatagcaaagacatggaatcaacccaaatgcccatcaatgatagactggataaagaaaatgtggtacgtacacaccatggcatactatgcagccataaaaaggaatgagatcatgtcttttgcagagccactgatgaagctggaagtcatcctcagcaaactaccacaggaacagaaaactaaacactgtatgttctcacttataagtgggggctgacaatgagaagacatggacacggggaggggaacaacacacactggggcctgtcagaggcttggcagagagcatcaggaaaaacagctaatgcatactgggcttaataccaaggtgataggttgataggtgcagtaaaccaccatggcacacgtttacctatgtaacaaacctgcaaatcctgcacatgtaccctgaaacttaataaaataaaaaagaaacttctcaccagcctcccttctcacccacttaaatgtggcaactggctagattactacagggaaactgctcttgccaaaatcatatataatctccttattgtgaaagcgatgtcacacctttgttctcctctcaaattgaacaaaattgacttctccattcttgacaacactctgttcccttgggtgccaccatccacagggttcctctcttatctgattcaatgctgattcggtcttttgtggttggggcgcatcaaggatcagccctgtggctgcttcttcatcctctactacatcctctctaggccacctcacatagcctcatttgcgagctgcttactgactgctctaacatctttaatctccagcaaagaagggagccataacccgcagctaaaactgaagacctggtgctgagaaatgaaatactgtgaaggacaacttggtacagaatattctgtaagtaggttgcagtgtaggtaagagaggactacctctggaacacaccacgaggacaggtataatccccattaaacataataggaatccaatgaccaaagttgttgagctaagagatagtggtatatacacattttttaaaaaaatgatataggctaatatcgaaagaaggagcatggaactggaagtacctaaagagcagaatgggagtgttccctcttttaggactctcagcattattttttatattttctttaagcaacatgcattattacttgaagatatatgtaaccaattaatgcaagtataaaactctgaaaatgctttctttcctgagatccccactcctcatagatccctacaaacttttatactgtcattaaagcttctccagcagttctacctccttaaattaccttttttccccctataatggaaaaatcttttctctaacttttaaatttatcccccactgtcccaacataaacataaacttatattcaattgtttcatttttgtgactgtaattattgttttgtccttttctaagtagtctcaatttgatctagttttcatatgtacaaagtttcatttttcttggagttagtaattgcctttgttttaatgtacttaatgacctttgtatgtatgtacatatgtatgtataacctctatttcagttagatcttagaatggataggaggtgaacatatctgatcagttagccacctaataagtaccaatatttttgtttgcctgtagagcaatcattatcagcccataaatgtggaacattctgagtatcataacatatttgaaacttgtgttaccacataaaatatgtatattttaaaaatctaccatgtctagtctgaatttaccaacattcccaagtattagttttctaatgctgtcatatcaaattatcatgaactgactggctaataacaaacatttattttactacagttctataggcttgacgtttggcacagtactcactggattaatatcaaagtgtcagcagggctgcattcccttctggaggctagggggaagaatgtgttttattgcctttccatcttctagaggctgcctgcatttcttagcttttggccctcttacatcagcaaccttgcatctctttgactattctcccataatcacatcccctctcctctgaattgaattcaggtgggaatggttctctgattttaaatacccaggtgcttaggttggttccacctggatactataggatggtcttcttatctcaaggccccttagccttaacgacacctgcaaagtgtcttttgacaaaggaaataactatttgcagttcccctgcattaggaaagatgggcacatctttaaaagaccattattctgcctaccacatctactatcatgttgcaatcttatctataaaaatgtttaacaacactggatatgttatattctctgaaaaattattttatttcctaagtcaaacatctataataagtaatcaactatgatgatacagaaagtgaaatgcatattctaacaaatagcacagaaattcatccttaagaaatatttgttagttaagaatgactataaataataattatataagtgcttccatttataattgcctcaaaactacactcttaggtaaactgtatcttcatacataaacaaggaaatagacaaggttatgtaacatgattagaatcacagaattcttagattgcaatatttgtataccatcattaagtggtagaagctaaactagacctagaatttaggtatgctgactccaagccaaatatacatgcacacacagacacatacacacacacacacacacacgtctcataaaatattttaaaaattgtacagaatcagctgggcgcagtggctcacgcctgtaatcccaacattttgggtggctgaggcaggtggatcacctgaggtcgagagttcaagaccagcctgaccaatatggagaaaccccatctctattaaaaatacaaaattagctgatgtggtggctcatgcctgtaatcccggctactcgggaggctgaggcgggagaatcgcttgaaccctggaggcggaggttgcggtgagcccatatcatgccattgcactccagcctgggcaacaagagcgaaattctgtctcaaaaaaaaaagaaaaaaaaaaaagaaagaaatgtatagaatcatatggaatcagaagttaaaaaaaaagtcaaatgcaaactcctgaagcaaaatgaattcaactgcatgtactataaaagatagttattatgacaggacaaattttagacttgtcaatctcaaaataatcctgttaaatcaagtcctatgtaatggagcatattcttattcttttaagccttagtatttgcttgctatcatgggcgaaatacagaaatggaatggtcagctccttcttgctaaagtatgtcagcctccatcttattatataatcacaattatctttattttgtcaaaagcctgtcatacttttagtaaagaatgaaactatggctgcacagtatcatgctgcaggccactgtgactcatgactttggaaagcaatcattaatcaaataaatttaaaaaacaagattcaagcacttctgtttgtgatgagttttgcttctccttttaaggaatatctcagtaattccttagaactgactggtccaaagtaaatagaaaagaggaagatgaaaaagaaacaggaattctaagtatttcttcacctaggttcagatgtttatatttttgcgtgattttttttcctgactagaacttccagagttttcatcatattatcaaagtcctgtgggacacaggaacttaaaatctatcttgtgctgactttaaattgttgcagaggccaacattaaaataatgttaaaaaccgataaaaatatttttctttataaagagtattgactatacacgtatatagaaagtatatcttatacaaatctgtctcaaaaatcagtcatttaatgcaattataaaccttactggtaatgccttgagaaaattagtattatcatggagctttcaatttattcttttatcagctccatgttaatgttttattgcttttttttctgcagcttacattagcacattcataactagatatgcttttttaaattcacgatctcaattattttattttattgttattattattattttgagacagagtctcactctgtcgcccaggctagagtgcagtggcacaatctcggctcactgcaagctctgcctcccgggttcacgccattctcctgcctcagtctctcgagtagctgggactacaggcgcctgacaccacacccagctaattttttgtatttttagtaaagacggggtttcactgtgttagcgaggatggtctcgatctcctgacctcgtgatccgcctgcctcggcctcgcaaagtgctgagattacaggcgtaagccactgcgtccagccccaattattttattttaaatggaacccttatagccttacaaggtttggcatgggtttatcctcttcatttcccaaaaatgtccatgaaatgttatttcccaaagtacttcctgtattatctatctctattaaatgttttctttccagatagtatcatcgacttacttgctggtgatttggggcccatggaaacaatagtaaaaactaaagtattcaatcaaagtagaatgtggaaaatcctcaaaatttatagagaagactgagatcatctagcagaaatagtaaaaatatttcattcattgcttcctatgtgatttgcattgtcttcatgatgcttacaatttagttcagaagttcctaattgaatcaaaatcagagagagataggtagcttctgttctaaagagaatcattccacctaacttgggatctcattccttgttgtatctagaacatatctttgagccattggttctatcctttgtgtaatctcagagagtggatctgtacacttgtcctttgtccaagttgtcattttccattttgtttcagttatctactctctgctttctttcttagctgtttggccagaatgccctccactccgacttctctttactatgtgtgatagctaagaaatagctgtagtatatttggagtattctttctgtcacttatgttctggcttcacagtcatgacatcccacttgagggtaaaacactagcagaactagagaaccgagagctaccaccacacctgcaaagctgactgcactactcatcctccccttgctttcctaacctgcattctagccatgcataaacatgataacaacttttgaagtatagtactgtagacttttttgtcttttccattttccaaattgttaatctgccaacaagttgaattacattcatggattagtcatttacatggattagtcattctgatttcacgcgtactagtctgcactccccaatgaatttagagattaaaggcaatgtgggcatatagaaaacagtcattatattattatattttacatttgtgttgaataatttttaatttcaaaagttaatagttaaaaattatagtgaattttctaacagtacagaacagtatatacaacattttgaattctcttttattcttccagctctttaattccacttcccggaggcatcaacttgaacagcatgtctctctctctctctgtgtgtgtgtgtgtgtgtgtgtgtgtgtgtgtgtgtgtgtttgtgtgtgtgtgtgtgtgcatgcatgcccacacatgtgtctatgaataagtatttgggttaaagtggatcatgctatatataccgttttacagctaacttttccattctacaatatattgcgagaatctttccatatcaatccatataaatttataatattatttttaatgattacagagtaatatactcattggtgtgcacaagccacaatttatttaaacagtttgtgactttaaatggtttttgagaaagctacttactataatggtaaatatatgaagatacagaagtagatggtatagtaaataatatagctcatcctatatcctgtcttcaccattgagtaacaggggtgtttcctaggtgaaagctgaactggtaacaaaatctctggttttaacataatgtaacatgtctgattaaattttttggtatatgtgaatagactgacaggaatgtcaagcttagggttttcaactcaaagtcacctagggtgcaccaaaattgtgtgagctggagtatggagctttctcaatgtgttacagaacatctagggcatttctgtcatttagctgacatgcacgacggaccacaaaatggtgaatgtcagcttgcattttgtagttttgaacaggcagcctctattccacttctcttgctttaatgaagttgacacaagaattctagagaaaaaagttctagttctatgcatcctgaatgagtgtttgaaggtcaattttagaacttattgttacaaagatcaattaagtatatgaggtgaaattatgttttgaatgtcatataaaggatctgatgaatgatacatattgtcttgggataagcctaatcaaaatccattaattggttttacatatttatgactaaacctttgaaaaagttacttaaaggtgaacaaatctaagcagacaaatacaacaattggatgcaagccaggaaatcttgagcaagaggaaaactttcactttttaaaatataaaactaaagccctcactttatatgtgatggcaatgctttggaaatatataaaaagcaaggatctccctcaataaaaataagtaagtagaatcttcatcaatataatcccagagacaggaagatagttattttaatgtgatttatttagctaaaagtaaatgtgaggctcttgagagggcaaaccactgcattagagagtgatttggaacattttttgcaaactaacagaataaaatcaacttcggtataagaaggtaaataaaatctagcagccaaagataaaaataaatctagaattaacaaatccagggcttaagcagtaattaaataacccagatttcacccttttgtgatagaacaggtacatttaaatgctattaacactttttttaattccattgatttctccatggatacatatgtgaacaaatatattaaccatctctttcctctcaaatggtaaaactgtttctttggaccactgtgcaactagtttctggacctaccatgtgtaacatttgttccacaaaatttagttcttaccaggttttttgtaatcactcccaaaggctcatgttagttctattgtcattgatcccaggagcctttttagatataggctgtaatccactagctaaacgaagcaagttttctctaaagctctcagcagagtttgatttggtgctatgttgcacaattccaagctgtgagttctcctgcttatcagttaaaaattaactttaagatacaggccgagtgcggtggctcacgcctgtaatcccggcattttgggaggccaagacgcgcggctcacaagatcaggagacggaaaccatcctggccaacatggtgaaaccccgtctctattaaaaatacaaaaaattagccaggcgtggtggcacgtgcctgtaatcccagctactcgggaggctgaggcaggagaattgcttgaacccaggaggcagaggttgcagtgatccaaaatcatgccattgcactccagcctgagcgacagagcaagacttggtcttaaaagtaaataaataaataaataaataaataaataaataaatagatagataaataaataaaatacactgtgtgcatattgtccttactttcatgtcatgtccccccagattctctgatctacaaatgaacaaattcctgttcagtcttaaggagaaaaaaaaaagtctctcctttagggatgagggttctattctgcctaggtttctaactttttatgtaaaagcatcaacgcatactcaggaaattaacctaggaatagtcatgaatgaggccttctagctatatttttttcactgttggtggagaagtattagaatcaactgtcaggtaagaaggtcattggcttaagctaagcactaagcactggcttgaaacagaggagaccaatcacagctgcaaccagcctgaaaatgcatttggtgtgtattcctttaaagtcataacatttggttaattttagaaaaaggaacaaattgaggtttaatgttcataatatatttttaaaagtaggacacactttattaataataccatactggtaaatattattgttataaataatgatgattttttcccaccttctgtgaactaaatagaattttccctgggatctgggattatggcaagtggatgaattctattctacaggcgaattaactaccactgtttcttgaccaatactgttcagatggtatcagtaagttttagagcttaccaggtttgtactaaatcatgagtcaagtttcaaacacaaatcaatttctagtgaaagcaattctgtcccagtgcctctgttttattattttgtgatatgaagattgatagccaaaacttttagagttgtaaagcatgccccctgaataagtcatttcctaagatgatttaatcagcagctgtatcttacggaaagtcacactttccaaactgagctggtgattatgcttgtgcactggctttaaaccccaccttcactactcaccagctatgtgaccttaaacaagcattttgcctcactgggccttatataaagtgattcatgtaaaatgcttcacacaatacttgatacacagtgagtactcaataaaacttaactattattcatttattattccagtataatcaactaactaccaagtgtccatttcttgtgtacaagatgctagagacagaaaagacataaatgatactatcacaaaagatatatgatctagttaggaaggtacaattgaagaatgaacagaaacgcaagtgcacatctgaaaataaaagataagtcattccaaagtgagtgataggagagaagtagggttagtcaaagaagatttcatggaataagtgaatccaatccgcatcttaagttaaatgaagactgcaggctaatgaaaattggggaagatgttctaggcaaagacaaataaaaaagtcacagtgaagaaaattaacaacatgggatgaggaagtgtggtgctgaggtaatgtaaataagagaaaataaagatgctccacaaaaatagaagaaaataaagaggcccaacagaaacagagaggtcatttgcaggaatgttatataagctgcagtaattaggaaaaagaaactagacaactgctacaaaaataaacaataaaaatcagtatagtttctgggaagagaaaaataacttgtcaaaaattacatttgaaacattgcgccagcaactgtaggctgcatacattgggtcaaggaaataccagaagcacagaggtggcaggtgaagttcttcaagcaaacgaactctctctgagggagttattaaaggaaataaaagcagagagcaaggccaaacttgatgaaagtccacaattagctgcagcctgtacaagagagatataaaaaatacaggaggagaaatgagaagaaggggcataataaagtacagaagaaagtctggtctctaatgcacagagcaatgaaaaaattgagaagaatatgaattagaaggagggggaggcaaatttgggtttgaaaatagttactagggtaaaaactgaaatcagaagggtagcttgatgccagatcatgtagaactagatcaatgtaggattcctgcattgtccttttactcagtaaaaaatctgaagcaatcatgattgggtctatattttagagatataattctgcccaacagtataaagaaaataatgaggacaaagcaagttgaaggcagggagatatttaagggatcacctacaaaactcagtgtgagagaagtggacataggaaagaagagaagaggaatttaagaaaaatctgagatgtagaatcgatatgatctagtggctaacaggtcctcttaattgctggtctttattacaaataaattatccagtttgggcataaagaggaaagattacaaagcatttgttttgaaaacgctgagtgtgaatggcctggaggatatgcaaataggcagatactaactggtatctggaatctggaagagagaagcagtgattgtttgtaggaaagactgtaaaccttaaggtgacatgcacatataaatattcctaatgtgtctagttacccaaagaaagtattttcctagtctgctgtacagcagtttaaaatagtgatcatcttaattgtaattggcttttatatgatgggtacatgctatctattgtatttcaagttaattcaatttcatttggaagaattgttatttccttggccatgtacaaaattaaatttagtactctttctcaggaagtaatttttagaaatattaaaataaaacagacagtaaattattaatctgtgattcaattttataaaacaaaaatctatctgaacaagatgagtcataatgttatgtgtaaaactaaaaacatttttaaataatatcatttgtataaaaagatcaattggtctgatacatatttgattgtaatttttaaaatttaaatatgtttctttttacagcagtatatttttcaaacagattccttaggagatttaatgcaaccttatgatcacggaagtggcgaaaattccatcaccaatcactcagttacttcatttgggacccatgacaaatagttgattagatttttacaggatatattaaaggatactgtcgaatttcttttcaaagtttatataaagatacagaactcaatacagtataatgtacttacatttcctctcatgagctgtgagtctggtgctacatattgaggacacgatttttaactttaaagctcaaactcctatggcataattatgttgaagattagtatctcatgacagaatttccccatttatcctctcttctccacagaaataaaacttttctttttgtaattaattgttgggggttttgtttgtttctcaagccaacaatgctatctttctttggtagtgataaatgtttttcctctttctttttttttctttgtttttttttttttttggcgatttcttttctttttttttattattatactttaagttttagggtacatgtgcacaatatgccagttagttacatatgtatacatgtgacatgctggtgcactgtacccactaactcttcatctagcattaggtatatctcccagtgctatcccttcccccgtccccccaccccacaacagtccccagagtgtgatgttctccttcctgtgtccatgtgttctcattgttcaattcccacctatgagcgagaatatacggtgtttggttttttgtccttgcgatagtttactgagaatgatgatttccactttcatccatgtccctacaaaggacatgaactcatcattttttatggctgcatagtattccatggtgtatatgtgccacattttcttaatccagtcgatcattgttggacatttgggttgattccaagtctttgctattgtgaatagtgccgcaataaacacgtgtgcatgtgtctttatagcagcatgatttatagtcctttgggtatatacccagtaatgggatggctgggtcaaatggtatttctagttctagatccctgaagaattgccacactgacttccacaatggttgaactagtttacagtcccaccaacagtgtgaaagtgttcctatttctccacatcagtttcactccatgttatcactgcttcccctcaattccagagatgccttacaaataccaaatagaaaacctcagttaagagagaagaattttcatgaaaaattaataacaattctgacaaagctaccacacatcttaaaatgatactctaaagtcattctcttgacaaaataactgaaccttgaaatctacacattcttttagaaaatacttttcagctcaaagtaacatttaataaatagttactgttacataaaatgctaatgatgacaatgaggtcagattagaaatcttcagattaatgaaggtaatttatccaaagtgtgagagaaaataaaaatatttttacacgtggggggaggttaccttagggcaatgttaagtttcgagccctgctgtcattatgttaaaaccatgtattctaagaacagtatgttccttttcctttttgttaagactgcaatttttaagtcatttaaataattcacagaaaaaaatagtaatcttaaaaattaattctagtatgccctagatgacaggcaagtgttgaaaaaataaatttctcatctaagcactatgagtgacatgaccatctggagcgctaattctaaatcttctgagatcacaattaatttttctttatccttatacaaatatttgctgtgtcctaaggtcttgctcacccagagcctctgtccttgtaggtcattttttaaaatagatatacacacccaaacctcactttggttgagttataacttacatacagtaaagtacacaagtcacgcgtatggagctccatgtgtacatatctatgtacccctagagcctcctagattaaaacataagtcatttctcacactccacaaagctctcctgtgcgcttacccagtcaaaaatcaacccttgaaggtaaccactttcctagctagcatcatcacaggtcacttttgcctgctcctggatttcacatgaattgaatgtattctatcatgtctgttttttttttccacccaacattatgtccatgagattcatcaatatcattggatgaagtagttttccttcatttctgtattttcttgatgaatatgccaatttatttactcttcttgtggctgatggtcatttggttatttccggttttttaatataaataatgccactatagacattttttataagcaacttatttttaattgcttagttttaggttacatgtatgttagttagtgtgttaacttatattagcttcagaagatggtaacacacagcttcccaactggtagtaccaatgtaccctcccactattcaatgtattttctttttttttttctttttttttttttttacatgcagtatgatttattttatataatgttcaaaagcttgcaaaaacagcatattgtttacagatgcatattttggaggtaaaattatgaagaaaagcgagatcattataaacaaaatttaggagggggctgggatggagaagggcatgcaaaagggctttaacgtgttggttgtaatctgtatcttaaactggttatgggtagtagggtgtccagtttttttttttattttttttttattgatcattcttgggtgtttctcacagagggggatttggcagggtcataggacaatagtggagggatggtcagcagataaacaagtgaacaaaggtctctggttttcctatgcagaggaccctgcggccttccgcagtgtttgtgtccctgggtacttgagattagggagtggtgatgactcttaacgagcatgctgccgtcaagcatctgtttaacaaagcacatcttgcaccacccttaatccatttaaccctgagtggacacagcacatgtttcagagagcacagggttgggggtagggtcacccatcaacaggatcacaaggcagaagaatttttcttagtacagaacaaaatgaaaagtctcccgtgtctacctctttctacacagacatggcaaccatccgatttctcaatcctttccccgcctttccccactttctattccacaaaaccgccattgtcatcatggcccgttctcaatgagctgttgggtacacctcccagacggggtggtggctgggcagcggggctcctcacttcccagtaggggcggccgggcagaggcgcccctcacctcccggaccgggcagctggccgggcgggggctgacccccccacctccctccccgacggggcggctggccgggtggggggctgacccccccacctccctcccggacggggcagctggccgggcgggggctgacccccccacctccctccccgacggggcggctggccgggtggggggctgacccccccacctccctcccggacggggcggctggccgggcggggggctgactcccccaccaccctcccggacggggcggctggccgggcagaggggctcctcacttcccagtaggggcggccgggcagaggcgctcctcacctcccggacagggcggctggccgggcagggggctgacccccccacctccctcccggacaggggtggctggcctggcggggggctgactcccccaccaccctcccggacggggcggctggccgggcggggggctgacccccccacctccttcccggacggggcggctggccgggcagaggggctcctcacttccaagtaggggtggccaggcagaggcgcccctcacctcccagacggggcggctattcaatgtattttctatttagcatttttggatcctttttgtaattaaattacaatttttgtcagctgtacataaaataatccatcaaagtgctcttcttttaagttagggtgcctctttcctcatcaaataaatgacttaaatataaacacaattttagcatataagatgaagagtgggaaatccataattcaacatgattatcaaatgtaatattggaatatattgaataaatatatttttaaatgtaattttaacaaatctcagaaaagtgttttgagtggcattctggtcctgccataaaattatgtaagttactaatagaaatggtctggattttgtgacagggcccacaatattgaaaatacatccacatatttaaatgcatagttaaaattaagtaagggcagattcaaatttcttgtcaccatacaaaatacagaaaacaccaaataaagatctttgcactgctggtcaggttaaaagacagaacatgccaatttaaattcaaatggaccactgcagctccacattacattaaggggaaaaataacctaagtcatcttgctattatagttgcagaaaatttcatacataagtaaatgtttctttaagtttatatgaagactattgttttaacaaaagcttgatacagcaagaaaagagactatggctttgctgagaatctgggtcacagaacataaaactcagcctgattctaaagtaaaggaaaagagcaaacgtgcaataatggagaacatggatagaatcctgtagctaccatgtactagtggtattaagctagtcattaagtcttcctgatattccacttcttttcctctacaaaggattataatatctacctagaagactattgcgagcattaagtaaggtggtaactcccaagagccattagactacctggtagatttcagtgggcttcaattacacatcagtcacctggaaagcttttaaaaatcccaatgcccaggccacatctccgaccaattaaatcagaatctctgtgggtaggaccccaggcaccagtatttcttaaagctcccaggtaattctgaatttgcagtcaaattgtgtatacttagaagagatccacatactaaaggtataaatagagaagatagggcagataccatttagtggagtgcggtagtggagaaagaaatgcaaaaccagccaggtgtggtggctcacacctgtaatcccagcagtttaagaggccaagatgggcagatcacctgaagtcaggagtttcagaccagcctggacaacatggcaaaactccgtctctactaaaaatataaaaattagccaggtggggtggcacctgcctgtaatcccagctacatgggaggctgaggcaggagaattgcttgaaccagggaggcggaggttgcagtgagccaaggttgtgccattgaaatccagcctgggtgacaacagtgagactccatctcaaaaaaagaaaaaaagaaagaaagaagaagaaacacaaaaccacagtgggaatcaggaggcagtccgtactatgacttggctcagatcatggagaagagggtaggaacagcatgtagtaactccaatgacaaatctctcccatcatgactttgaatcactctgctaggtctttacagtgtcagaaacatctgctttatcttcatgcccaatttgctttattccttttcctttctaatttagcatttgactttcataaaatgaatgcatgcaaaggaaagtctattttaggctatggagaatcttttattaatatagatgtacagaaatataagttaaaaggtttcctagatttcataaatttcaccatgctaaaattattgggccaatttacctttgcgggaaagaacatcaatcttccttccaaaacacgttgaagataaattgtcataatttaatcctttccattatagctcccctgttctattatgtgaaatatttaaaatataatttttctaaactgtccaaaatagaattatagcctataaattcttacaaaatcttcaagacaacaaacgttaaattccatgcctaagttaataaatatgtatgcttattcaattttttaatgaataaatcccaggaatcaaagaaatcttgagaaaattattatgctaaccctattaagtagcccaaaaactatttaaaatataaatattttttgaattttattatttttatggtagttgtaggaatagggtaataggaagcataatgtgtgctactaagtgttcacaatacatgaatgcttttcttttgcaattttttattttattatccttctagtttaacagaagttacagtgatgactacaaaaataaaagacaaattgatctatttccagtgaattttatgaactaaggcatgtaatacccatgatccaattgaaaatactcattatgtttctcaatgattgagataattgcctggactcaactctgcactttgctgcttagcttatgtataaatgatttgaaatgtcatctataagctacctcaaagctcctataattatgaaagttttataatcatatcagtttagaactagagcaatccagagaaatcatgtagctcattcaactcttaattcctcagatgaaaaaacagatttagataacctaaattttcaatcataaccaattagaggtagaggagattagcacccaggtctcaggcttacaaatccagtggttgtttcttatattatagcatgataccttcagtcatgctaaaaatttttttaaaaaagatttaacacctcattgattttagcgtatcagtgaaactgaacagatacattgctaattaaaggaatttaatgtaattaatattttttaaaaagttgcctgcaagactatactttcagggatcatttctatggttcattactagggaagtttccctgaatgtgtagagcaccgaaaacactcttcaggatactatccagaagaatttccccaacctagcaaggtaggccaatattcaaattcaggaaatacagagaacaccacaaagacattcctcgagaagagcaatcccaacacacataatcgtcagattcacccaggttgaaatgaaggaaaaagtgctaagggcagccagagagaaaggtcaagttacccacaaagggaagcccatcagactaacagcagatctctcaacagaaactctacatgccagaagagagtgggggccaatattcaacattcttaaagaaaagaattttcaacccagaatttcatatccagccaaactaagcttcataagtgaaggagaaataaaaggctttacagacaaggaaatgctgagagatgttgtcaccaccaggcctgccctacaagagctcctgaaggaagcactaaacatgaaaagatacaaccagtaccatccacgacaaaaacatgccaaattgtaataaccatagacactatgaagaaactgcatcaactaatgggcaaaatagccagctagcatcataaagacaggatcaaattcacacataacaatattaactttaaatgtaactgggctaaatgccccagttaaaagatacagacaggcaaactggataaagagtcaagacccatcagtgtgctgtattgagcagacccatctcacatgcaaagacacatataggctcaaaattaagggatggaggaagatctacaaagcaaatgaaaagcaaaaaaagcgggggttgcaatcctagtctctgataaaacagactttaaaccaacaaagatcaaaagagacaaagaagggcattacataatggtaaagggatcaatgcaacaagaagagctaactatcctaaatatatatgcaccccatacaggagcacccagattcataaagcaagttcttagagacctacaaagagacttagactcccacacaataatagtgggagactttaagaccccactgtcaatattagacagatcaacgagacagaaaattaacaaggatatccagggcttgaactcagctctggaccaagtggacttactagacatctacagaactctccaccctaaatcaacagaatatacactcttctcagcaccacatcacacttattctaaaactgaccacataattggaaacaaaacactcctcaccaaatgtaaaagagcagaaatcacaacaaactgtctctcagaccacagtacaatcaaactagaactcaggattaagaaactcactcaaaaccgcacaactacatggaaactgaacaacctgctcctgaatgactattgcgtaaataatgaaatgcaagcagaaataaagattttctttgaaaccaatgagaacaaagacaaaacataccagaatctctgggacacctttaaagcagtgtgtagagggaaatttatagcactaaatgcccacaagagaaaggaggaaagatctaaaatcgacaccctaaaatcacaattaaaagaactagaaaatcaagagcaaacacattcaaaagctagcagaagacaagaaataactaagatcagagcagaactgaaggagatagagacacaaaaaacccttcaacaaatcaatgaatccaggagctgattttttgaaaagatcaacaaaatagatagactgctagcaagactaataaagaaggaaagagagaagaatcaaatggatgaaataaaaaatgataaaggggatattaccactgatcccacagaaagaatactataaacacctgtaagcaaataaactagaaaatctagaagaaatggataaattcctcgacacatacaccctcccaagactaaactaggaagaagtcgaatctctgaatagaccaataacaggttctaaaattgaggcaataattaatagcctaccaaccaaaaaaagtccaggaccagatactttctattttgatagaaagtatctcaaaataaaaagagctatttatgacaaacccaaagccaatatcatactgaatgggcaaaaactggaagcattcccttcgaaaactggcacaagacaaggatgccctctctcaccactcctattcaacatagttttggaagttctgctcagggtaatcaggcaagagaaagaaataaagagtatttgattaggaaaagaataagtcaaattgtctctgtttgcagatgacatgactgtatatttagaaaactccatcgtctcagcccaaaatctccttaagctaataagcaacctcagcaaagtctcaggataaaaaatcaatgtgcaaaaaccacagacattcctatacagcaataacagacagagagccaaaccatgagtaaagtaccattcacaattgctattaagagaataaaatacctaggaatacaacttacaaggtatgtgaaggacctcttcaaggagactaaaatgactgctcaaggaaataaaagaagacacaaacaaatggaagaatattccatgctcatggataggaagaatcaatatcatgaaaatggccatactgcccaaattaatttacagtttcaatgctatccccatcaagctaccacaattttcctcacagaattggaaaaaactactttgaatttcatatggaaccaaaaaagagcctgtatagccaagacaatcctaagcaaaaagaacaaagctggaggcatcatgctacctgacttcaatctatactacaaggctacagaaaccaaaacagcaaggtactggtaccaaaacagatatatagaccaatggaacagaacagaggcctcagaaaaaacaccacacatctacaaccatctgatctttgacaaacctgacaaaaacaagaaatgcaggaaagattccctatttaataactggtgctgggaaaactggttagccacatgcagaaagctgaaactggaccccttccttacactgtatacaaaaattaactcaagatggattaaagatttaaatgtaagacctaaaaccataaaaaccctagaagaaaacctagtcaataccattcaggacataggcatgggcaaagacttcatgactaaaacaccaaaagcaacagcaacaaatgccaaaatagacaaatgggatctaattaaactaaagaacttctgcacaggaaaagaaactatcagcagagcgaacagacaacctacagattgggagaaaatttttgtaatctatccatctgacaaaggctaatatccagaatctacaaagagcttaaaaaaatttacaagaagaaaacaaccccatcaaaaaatgagcaaatgatatgaacagacactactcaaaagaagacatttatgcagccaacagacatatgaagaaatgctcatcatcactggtcattagagaaatgcaaatcaaaaccacaatgagatactatctcacaccagctagaatggcgatcattaaaaagtcaggaaacaacagatgctgcagaggatgtgaagaaataggaatgcttggccgggcgcggtggctcacgcctgtaatcccagcactttgggaggccgaggcgggcggatcacgaggtcaggagatcgagaccacggtgaaaccccgtctctactaaaaatacaaaaaaaaaattagccgggcgcagtggcgggcgcctgtagtcccagctactcgggaggctgaggcaggagaatggcgtgaacccagaaggcggagcttgcagtgagcggagatcgcgccacagcactcccgcctgggcgacagaacgagactccgtctcaaaaaaaaaaaaacaaaaaacaaaaaacaacaaaaaaaaaaaaaaaaaaaaaaaaaaaaagaaataggaatgcttttacactgttggtgggagtgtaaattagttcaaccattatggaagacagtgtggcgattcctaaatgatctagaactagaaataccatttgatccagcaatcccattatttagtatatacccaaggattataaatcattctactataaagacacattgcacacatatgtttactgcagcactgttcacaatagcaaagtcttggaaccaactcaaatgtccatcaatgatagactggataaagaaaatgaggtacatatatgccacagaatactatgcagccataaaaaaggatgagttcatgtcccttgcagggacatggatcaaactggaaaccatcattctcagcaaagtaacacaagaagagaaaaccaaacaccacatgttttcactcataaatgggagttgaataatgaaaacacatggacacagggaggggaacatcacacaccagggcctgtcagggggtgggtgcctgggggagggaaagcattaggagaaatacctaatgtaaatgacgagttgatgggtgcagcaaaccaacatggcacatgtatacctatgtaacaaacctgcacattgtgcaaatgtacaccagaacttaaagtataataataaaaaaagaatactgcacacccctcccccaaaaaaaatgttgcctgcaagtcattttcttgtaggttggatctcctttaagttcaataaagtatactgattgagagaagtattctaaagatgctttagaaaaatacgttgctatttacaatgtattacttaaatatatttgatccagcagcattgacatcactaaaagattgttagaaaagctgaaagtcagggtgcaccttaaatccaattaaacagtatctacattttaacggcttcccaggagccctgggaagctgtatattcgctcaagtttgagaagtatggcagccagctccagcccatccaaggaaagggacattaaatacaatctggtcagcaggcctcattgatcaaacatgtcagttagagacctgcacacttaatgaagatctcatagctgatctgaggctaagttagaatttaggcattccaactctatactataccatgttagagcattgtgtgatacttactgccccagagcaaatccgttcctccatacagatagtataagaagggaaagcaatctacacttcagactgctgcaactgttctggttccaagccatcttatactaaatataggactaaaacaaacaaacaaagggcctagctttcttccacccagggatgctaaaaggaagaaaagttaaggcagtttatatatgcaattgcaacatttcttgtgagtgtaaggtttgctgaagattttggtagagaatctttatcaatttaagaaagaattccctttgattttactttgtgctgagaattttgtttataaataattacttaatgctattagatgattttctgcaacgattttagatatgttttttctttttaacatgttaatattgtgatctgattttcaaagtttgagctacattgtattcataaaatgaaatcatagtgatattttcctacatgtttacctttttatttgttcactattcctttgtgcagaatttcctaacattattttttttcttctggaaataaataatttaggagtacccctggtgtatatctgttggtgttgaattatctcagcttctgttattttgaaaatatctttcatttgtctttatttgtgaggggcaattttcctggatataattccaggatataagtactctaagctcttgaaaaacacaagttagtgtcttccatcttcaattgttgccattaaaacgttagatgcagagcagcattctggggagatagtggagtaggaagcatgaagaaactgtctctgtacttaaacaacaaatgcactctcagaatgtttgatggaactattttggaactattgagtctatgaaaggcttgcaaattctggtaacgcatcgatggtaaatttcagctcttagcacaatagcagctcctcattctcaaccctcatccttctgacggaaaaatgtgcagggattagaagagcagcttgcacacagcttgtggaaagcagggtaccctcaaagcactctgtcctccaaatattaggaatctgtgatcctgtcagtgattgctgcttctgatcacagaggtgcagaaaaatgatgggcagccattttgttgcactttccccattgttgccaataaattccccttgagacgaagtgactttcagaatatttaaaggaccacaacatcatccatccattcctcatttctcatttttctatttttcccatttttgcagcaagacatagaaggacaggacattgaaaagcaatttcatagatgaagaaaattagaaagtgaccatgtatgctgaggaaaaggcacagattcagaaaagacctgagaagaccttaagtttacactttgaagtaattctcgttataaagacagcatgaaaattaaacaataataatgatataataataataataataataagcaaaacaccctgaaaaggggggaaatgtgatttccaaatttactacataattagattcaaatgtccagtttcaacaaacttcacgagatattcaaagaagcagaaaagtatgacccactcaaaaaaaaagaaaaaagcaacaataattgaccctgaaaaagatctaatggcagatatactagacaaagactaagacaactgcctcaaagatcctaaatggcatctttaagatatggagtcaagaaaataatttatttaaaaaatggaaatatcaacaaggagatgggaaatctaaaaagaaccaaaaatacattctagaaatgaaaagtacaataacagaaatgaaaaattcattagaagtatccaatggcagagttaagtaggcagataaaagaatcagcaaagtcgaggaaaagacaatgtaaataagtgagtctgaataaaatttttaaaaaatttaagaaaggtgaacagaacctatgaaacagagtcaagcatattaacttacacattgtggaaatcttagaagtaaaagagacctagatgaaggcagaaataacatttcaagaaataatggctgaatattcctcaaatttgataacagacataaatgtaaacatccaaaaggtcgatgaacttcaattacaatgaattcaaagagaacaatttcaaaacacattataataaaactttgaaaagaaaaaggcaaatagaaaatttttaaggcagcaaaaagcatttcatcacgtacaagggattctcaataagattgtcagcagatttctcatcagaaactatacagaccagaaggcagtgggcgatatattgaaaatgctacaagaaaaaaaatgtcaatcaagaatcctgtatcctgcaatactgtcttcaaacctaaaagaaaaattgacacatatccagatcaacaaaacctgagggacctcatcaggactagacctataaaatctattattttagtaatggtttgtaactttaatatttgtttccacataatttaagatattaatacacttttttaaattattaatgtaaaagctagtattattgtaactttggtttgtaactcagcagtttgttttatacagaatttaatagagtaatgcatttaaagaattatcagtgtatgttttggggcacacaatatattaagacgtaattttgtgacataaacaactaaagtggtgatgactacactgtaaataggcagcttttgttgatcaaagttaagctagtataacaaattagagtactgtaagtttaggacattaaaatgctgtccccatagtaaccaaagagagtagctatagaatatacacataaggaaatgagaaaggaattaaatgtttcaatataaaaaatcaattatacaaagaagaaaatattaatgcaggacatatgggacaaaaggtataaggtataaaggaaacaaacagaaaaattacagaaatatatccctctttatcagtaaccactttaaatgcaaatggattgaatcctctactcaaaaagcagggatttgaagaatgggttttaacaaaatgttccaactaaatgagatcttagaagatgctcactttagtccaaagacacaaatagattgtaagaaaaagcatgaaataagatagtccatgcacattgtaaccaaaagagagcagaggtggatacacaaatatcagataaaatatactttaactaaaaaagggcataagagccaaaagtacattagatatcaataagttttcatagaggaaaaaagtataataattataaacatttgcaaaccaaataacagaccatcaaaatatataaagcaaaaaatgacagatttgaagggaaaaatagacagttctacaataatagagacttcaatacaccatactgaataatagatagcacaactagacagaatattagtaaaaaatcagaggacttaatcaacagaatacaccaaaaagatctaacagacatatacagaacattctacccaacagcaacagcaacagcatgtacattctcctcacatccacatgggacattttcaggatagaccatatgctaagacaaaaatcaagcctcaatagattaacaaagacagagataatacaacctgtcttctccagccacaatggaatgaagttaaaaataaataacaagaaggaaaactgacattctcaaaaaagttgtaaaaattaaacaacatacttttaaacaaccaatggataaaataagcaaacacaatggaaatttaaaaatacttagatatgaataaaaacgaaatcacacatcaaaatttggggaacacagtgagtatagtgctaaagagtaaatacatactttcaaatgcttatattagaagtaagaagatctccaatcagcaacctgattttacaacttaaggaacaagaaaatgaagatcaaactaaacccaaagctagaagaaagcaggaaacagtaaaggttatagcagaaataagcaaaatagagaatagaaaaacactacagaaaactaataaaaagttgattccatgaaaaaaatcaagaagtttaatgaatttttaactagacaaactaagaaaaaaaagaaaaatcaaattattaaaatcagaaatcagagtggtgacattactacaaattctatagaaataataaagcttatgagactatagttaagaattctacatcgacaaattacatatcttagataaaatggatgaatttttgaaacaaaagcactgtcatcactaaatgacagagaattaagaaatctgaatagacctataattggtaagaagatttaatcaggagtcaaaattctcctgattaaaaaaaaaaatccctggtgtcttcactggtgacttccaccaaatgtttaatgacaaactaatacaaatattttccattattttccaaaaaatcgaagaggaaggagcaactcttagtagaaaagcttcacaacattggatttggcagtgatttcttggacatgacatgaaaggcacagacatcaaaagaaaaaatagacaaaatgaactacatgattttttttaattgtacatcaaaagattctatcagcggagaattttatccacagaattggagtctataattataaatcatatatctaaaaggaattaacatccagaatgtatagtgaattcttaaatctcaataacaacagcagcaaaaatctaataatctgatttttaaaatgagcaaatgatctgggtagacatttcttcaaagaagatatacaaatggccaacaaacacatgaaacaatgctcaacaatgctactccatgggaaaatgtgaagaaaaacttcaatgagatatcacctcacaaccattaggatgattataataaaaaaaacagaaaataaaatacatgttggtgaggatgtggagtaactgcaacccttgtgtactgttggtgggaatataacatagtattgccactgtggaaaatcgtattgtggctcctcaaaaaatttaaagtagatttatcatgtgatctgttaattccacttctgagaatgtacccaaaatattgaaggcagtttctcaaagacatatgtgtacattcatgttcatagcagcattattcacaatggctaaaactaggaagcatcacaacagtcccttactggatgaatgagtatcaaaatgtggtgtataaatacaatggaatattattcagccttaaaaaggaagaaaagtctaatgtatgctaaaatgtggataaactttgagaacatcttgctaagtgaaataagctagtcataaaaaataggttactgtatgattccacttagatgatgctatggtttgaatgtgtcccacaaatttcatgtgagatattaattgcattaacctccaatgcagcagttttcagaagtgggacctttaagtggctgattaggttaccaggtcaccagggctctgcctgcatgaaattcttaatgtcattatcatggaattgagttagttattgtaggcgtaagcttgttataaaacccagtttggccctctcttgatctctcttcctcttccaccttccaccatgggatgatccatcaggagggtcctcacgagatgaagtcctctcaaccttgggcttcctagcttccaaaactgtaagaaatacattttttcctttataaattacctacactgtggtattctgctatagcaatataaaatggttaagacatgaggtacttaagagtagtcaaaaatgatagagacagaaagtagaattataattacaaggagctgacgggagaagggaaaattattgtttaataaagatacagttcccatcatacaagaagaaaataattctatagatggattgtggtcatggttgtacaaacagtatgaaattatttaataccaccaagccctacacttaaaaatggttaggatggtaatttttatggtatgtatattttaccacaataaaaagttttgaaaaaaaaagttggatgtaaatctcatctttattccattgttgatcatctgtattttctctctggctgtctgtgagatctctttgtctctagcattctgtattttcactgtgctatatccaaatgtgattcttgtttttcttgcttttgtttccaatgtatctcaaatctttcatcatttctatacactatttcagctacttttatctttaatattgttttttttcttaccaccttctacattctctctttgagaaaatacaattagatatatgttgaattgtatttatctttcattgtttttaaccttttaaaaattttttcatctcattttctctctgtgctacaatctaatttttagatgtaccctcctctactgcaaaagtctttttccctagctctttgagaaataattaacaaacaaaaatgttaaatatttaaggtgtgcattgtgatgctttcatatatgtatacattgtgaaacgattactacaatcaagataattaacatatccatcatctcatatagttaccattattttgtagtgagaactcataagatctaccctgctagcaaatttctagtatataatacatcattattaattgtagccaaaatgaggtacaatagatcccatgctttattcatccttactaaccaaaactttgtaactattgactcaaatctcaccatgcctttttaattgttcctactgttcattttttcagcttaatgaaaccattcttttaaaaaaaaatttgattggtatgattttccttgccagaaattcatttttcttctctttcaaatataaatggccaatttttacagtcatttgtgcctttttcatgcttttgactccatcttttttggtttgttcaaagagattaatgtaattattttataatctgtatatagtgattttactatgtagtcttcacaaatttaatctgcattttaaacctttttataatgtcttatttctacacatgtagtattaatttgtttgttaaaattaatgttctttggagtttgttttttctgtgagaacaattaaagttgtgtattttatttttttccccacagagaagtttggtatttacatcagttacacacttaggacaccaacttcccaagaccacttttcattaaagtttacgtttggagccatacaagttagtgtgaatgagcgccccaatgccatagggaagatgactcatgattaggaaatcccagggagacactttctttttattaatttacctcttgctattgactggtgagactaagaaagccacatttcttcctccttcgccccttgagagaacagtcctaattcatctcagttttatatggggacaggccatggaagtcttaccagcatacagaaggtagtctgtatcattttgttaagtgaataaataagtgcttctcaaagagaagttatttccaatattaaattgaccacttcagcagcgcttattaatggtctttagaagttacattttcttttgcttcattagagtaagaaaggagccaatgagatttttagaaaaagttgaataacataaacattttctgaaacataaataaacatgtcatatgcagttaaatatgtgagcctttgtccacaatcctattctatataactagatgttctatatgtggaaactgtttcttaaagttgtgccttaagatggaatcaatctatgtgcatcacattttgggaacacttaggccatgaagatgttggttatacccaaaatgcttccccccgtcactaccacctgccttccttgaatctctgtgttgcaacattctctagaaagatgttaactcttaccatgagagaatgagcaatctgaataaacctttgcatgtccacactcagtgatataattcatctaacaataatgctttaggttacttttgattgctaaaacttgaatcaagtatttctgaaatggatagaagggtcctatgcctagggtgtccttatatatattattataaatggctctacagaaacacaaagttcactctgctatctctttaccatgcctctgcttcaatgcaaaaaatggcaaatttcttcagttcaaagaacaccagaatttagcttaagtaaaatgcctagtgtcattccatcagtaaaagaagtgcagttccctaactgaggtaaaattcaagtaactgtcagcggttcatattatctctcactgcatctgtaagattatttcaattgggaaaagaagtagcagaagatacttgtaaggctttttacaaacgcttgcaatttttctctgggaactttctactcttctgtctgtttgacccttcagagaaagttcatcttctaaaagaaccacagttttttgccacagaaccatcagtcttaccaaggctgaaaagcagccctgaatctctcccaccacttaaacttcattatctgcatattaaatgattttaggcaaagtatccccattttataaatttatttcttataataaatgcaaaagtgtgtatctgctttgagaacaaaaaattgttatttttttgtttttcctcattttgagggagaaaagcatgaaaaagaaaatgactactattttcatcttctattgcaattgcatggtttgaaaaccttaatgccaaatctaatagctgaatgttattaatatcccataccacaaggaagactggaaaacaggaaaagtaaagtaaaagtttgacagtttccattaaatgtgtgctgatatttttctgtaatactgagatttttttcaagataaacaatttaactgtatttcctaattttacacatgtaagatatatgctccttagatgccttgctatgaagaataaatgtgttcctattacacagtgcttgttatgaaagactctcacagttgtatagctcatttgactacatcatatgacactgtgccacatcattaatttatgcaattttgttggacgttagtctgttgaatataccacctgttgtgtatactgtttatctctgttactgtgtttgatatttcgttgctatgtcaaaattaataagttactattggtattttgcttcttcgttctactatataaattatttagcaatttctttaagtaaatgccacttaccacttttattacaataatgataaagataattcttaaaataataatgaacaagatgataaacataataattaacattttccaaagcattttcacatattgtattcacaacaatactgtcaaataagaagaaaggtctattatcttccttgcacagaagaaaaaatagattaagaattatcaggcaacctgtccaatattatataatttgtaatttttatacaggatactcagatttgcaggagaaattccacttcagaaagcaccaaattaccatcacattgatttccaaatgcctaatttaaatatctagatatctaaatatctgaagtcatttttcagaaaatgtgcatgtaattttccagagacatatattatagatagttattaagttcgaatataaccctcaaataaccaattcatctcaaataaatgtgaaaaataagtaagacagagactaacattgttttttagaaaaactaccagtttctcctgaggtaagtggttgctttctcctttcaatgtaaagagaaaaggtttagctctgaaactgttctgtaatgcttgggattcagaaatgtgcaagagtacatcctgctttcatttaggtgacaataaaaacagaaatgaagttaagttagtccatgcaattattatggaagaattagtataattatagatctcaaaggtatactcaacatctttttaaaaaataaattcagaatatgcatatagttggtaatgtccattcccagcaggaataactgaaaaggacaaatatttgaaatgtcatccttattaattgatggtttctcatactcagcttgagcagagtcaataaaaacattaccttgatgaaggtacaaacttataagaaaatatagttaatatttacagtagggagataaatgatcaataaaatccctatttgtttttgttttatttataatccagcctgcagttctgcttatcttttaagtagatagggtcactaaggaggctcctgcagggtgcaaggatgcctgcagtcaaactcaccaccctggaaagcaagcagtgctgccttcagctaaatacaatagagaacactgtcagttctatgctcctagaatattgtgaggcacagaaaaacaaattaggaaagggttggcactccagcccttacagcaacttctctgttgtttattcccttttatttctgtactgagtgcccaaggccgtgagaccttacctcttgcatcaatgtgacctggatgtgagacatggagtcaaagaagatcattttggaactttaaggtttaatgactgtcctattggatattggacttgcatggggccctagcccctatgttttggccaatttctcctatttgaaatgggcgtatttaccaaatgcctgtgcccccattgtatataggaaataattaacttgcttttgattttacaggctcataggtggaagggacttgccttatctcagctgagacttcggacatggacttttgagttaatgatggaataagttaagactttgggagactgttgggaaggcatgattgtgttttgaaatgtgaagacatgagatttgggaggggcccagggatggactgatatggtttggctgtgttccacccgaatttcatcttgaactgtagttcccataatccccatatgttgtgggagggacctggtgggaggtaattgaatcatgggggacattaccctcatgcttttctcatgatagtgagttctcacaagatctgatggttttataaggggctttgccctgcctttgctctgcacttctcattcctgctgcaatgtgtaaaaggacatgtttgctttcccttccatcatgactgtaattttcctgaggcctccccagccctgtggaactgcgagtcaattaaacctctttcctttataaattacccagtctcgggtatttcttcacagcagcgtgagatgaactaatacactgagatttaccttcaaaatatattttatatgaatatttaaatgtttctctgtatactatttttaaatttaatactgggatcaactttagtacagagcctattcatttatgttctttttaacacttcatgtacatattcagaacaaaaccaacataatctcaatcaatgcttcatgaaaaaagaagtaaatgcattatatggtcccaaggaactactgaattattcgtgcctagagttaggggcaaattggcaattatgttgtgaggcaggatacattcatcccgttagaaaacacactgtaagcttctccagccaatctatgaaaggattattttctgactgatggaagatcagtctgaaatctaacatcagactcattctaggaaaataaagtgggtcaggcatggtggctcatgcctataatcacaaccctttgagagtccaaggtgggaggatcgcttgaggctagaagtttgagaccagcctgggcaatataattagacccctctttacaaaaaataaaacaaaaaattagccaggcatggtggcacatgcttgtagtcacatctattcagcaggctgaggcagaaggatcacttgagcgcgggggttggaaaccatagtgagctatgatagtgccactgcactccagcctgggcaacagagtgaaaatctgtctccaaaaaaagttgaggaggtggataattggaactgaatactgcgatggttgattttcctaactcagttgaaaacaatttcagaggcttcaagataacgttctaattataggattgttttcagtgcaagatttcatgaactcaagtaactgttttctttaaggaacttaaaagaatctcccttcttttcaggtatgcagaagacatgtcaggatcttaactagtagagacatagggtcttgcaaaaggagggcccagggcaagtctggttgtattagcattactagtatttgtcattatgctggcagccaaactcctgctgacattatggttgtgtggtttggtacttcttcttacttctggctgtgaattagcaaatcagtgtcttatatttaaggtgcaaacaatatggctgatcacaaagagctggaactataattaaagaaaaaaagcaatgaatgtatttcatttgtttaatatcataataggtccccacttgaaaatcaaataatccaccttttgaaattgagattgagagacattagtagtttttgacaggggaaaaattccagaataaaaactgatttaaatgaaaaactaatcatgatctcaaataacaaaaatgtgcactaacacattctatttgtttaatttcaaatggataagctaataacacagctagatagataaaataagagaaaacttgtgcaaaactcttaaatgcccaccctttcataaagaactaaaagataagtataatttttagagtcggactactaaatactgtttctatagagacatttgaagattaataattacatacatttataaaccacaaaaattgaatagtgaaataattatgaacatacgaatttcactaagtaaaacagtatttgcataagaacattgaactttgtatataacaaatgagataataataaattaaataatacaaataagaagcagagcttcctagggagtaacaaaagaaaggttcttaacatttcactgaaaaatattcttaaaaaatagttctgggaaactgaagtattcaaaatgataaagtcattagtcctggttttctgaacaaacaacaaattaacaagatcaaaagcacaaacataatggaagagttacttggaagtgaaagataaatttctatgtcaaaagtaataaataacaggagacgaggtatatttttagagcataaaattatctcatgctaaagtttgtttttcattttttaaattttggaagcatacacttttcattaattagactaaaaggccttaaagtaaattaataatcaagtagaataataatatccataaatattatatgagtacgttctatttcctactatagcatacttaataggtgaaataattgagtcaaactttctcctaaagcatataatcaataaaaataagtaatttattatattcaaagttcacatttggaagaattttagtgctgcctgacagaatagagaaaaatcaaagatatgaagggtgtaacattttaggtgattagggaagtagagcaagggccatgatttaaaaagtgcaataattgtacaaaatatgtcttcctgtccagaaggtcaaaagtaggtaccagtagccaatgaatttcattgatctagaatctttgtatgtaagaacgatgcccttacacaggggccatgtggaagagttgattttttttttttttttgagatggaattttgctcttgtcactcaggtgggagtgcagtggtgctatctcggctcactgcaacctctgcctcccgggttcaagcgggagccttagcctcctgcgtagctgagattacaggcacccaccaccacacgcgcctaatttttttgtatttttagtagagacagagtttcaccatgttgggcaggctggtctcagactcctgacctcaggtgatccacccacctcggccccccaaagtggtgggattacaggcatgagccaccgcgcctggccagaagagatgcaatattttattcttcaaatactgcaactgaaaaaatgaaaagtttgtcttaaaattcaagaaatcaaattattcttcattttaaactcaatcaaatcatccccatatagaattttttgtcaatttgccttgattcattgtgacttttcagtgtttggctttccatttcttattctccctttcagagatacatacctattgatgactttgttagatatttattgaaagtattttatgtgctaggcaaaaacaataaaaacaaacctggtttctgcattcatttgagcttaaagtatcatcatcaaaagataccattaacttttaatgatgccctcaaagtcacatttttttcttcatcttttgcctcaaatattattttcttctatcttcctaaagtcatatcttcttttaaattatctttcagtaaatactattttttaaaaaaactttctaaataaacattgatgagcatttagttcatgtgctgttttgtgctataaaattttaaactaaatttgggtcagaggtctcttaaatcctttactattttcttattccattttgttagtaattatgcaattgtaattagaagacagatattattttttttaaaagaatcccattttccttataattccaaattgcctgtagtgctaacatatttcactaaacgctttacatatgttttcattactggtcttaatttacacagtgatgacttctcattacttattcctgaagtcacttttaatcttatgtctttggtttgtgattttgtttataccttcccccggctgaaccaccatatgttcaagaggtttagtctgaaatttcttgtctattcaatatttctttgtctgccttaacaatttttcaaactgttacaagttttccccttcatcttctgacacaagggctttatagccatgctgtccctttaatttgtccctgctttccagacatattcctcttcctgctctcttatcactagaatctcctttcttctgttcattctccttttaccagcattaccatatcctccatttttatccccagggttattgctccttttattttgttatatatttgtatcggaaggcaagccctaacctaggcactgaatgtgttgagtagcactattcattcaaaaacatttgtgaagcaactactttaagtcatgccttaaataagaatctgaggatataaagaaaactacgtcccaattctctaactcaaagtatgaataagcaaatggagaacccagcttgtgaaataaataattaaaatacaaatggcattaatttttataaacaatacaagtatattccttgggaaggaagtgaagaaaaggtagaggggttatggaagatatcttagaggaggatgtctcagtctgtttatgctgctataattaacgtctaagactgggtagtttataaagaacagaaatttttttgtcacagttctgggggctgggaagtccaagatcaagatgtcagcatattcagtgtcttgtgaagactcactctcttctgcaaagatagcactacttactgtttcctcagatggaggaaggtggaaaagcaaaagggataaacagttccctcacacctctttcacaagatctttaaatacatttatgagggctttgccatcatgactaagtcacttcctatatgtcccacctcttaatactatcacattggtgattaaatttcaatgcatgaattttaggaggacacattcagagcatagcagagggcatatttgaactggctcttgatatacaatgaatgggtaagagaacatagaaggtgagtaaagcattcatgacagtggaactagcatgttcaatgacaagtataaagacctgcgtgtattcaagtctacatgtagttgaagaacagggtgggtggaaggtgagactgcaaaggtaaatgtggatcaggtcatgagaagccttgcaagatacttatgacttaggttacttcttgtgagttatggtctgtaactgaaagatttcaagtcgaggggatatctgcagtgtaaagataattattgagacagtatggagaatggattagaggaggctgaaacatgagtcaggattagtgggaagtaattacaataattcagggaagaaatcacgggattctggaccaagacagtgagagtgttgatggaaaaacagtaaaatattagagattgtttaggaaagggcatcagtatttaataactatgactgggaggagaaagaggttgaagaaggtaatccataatgaattcaggcattgtccacaaggtgaatggtggtgtctttaactaagacatatttaatctacagtaataattgagagaatgctaaatatcactataaaataacaatttctggtaagtttatttatcttagataattaaatagagtttcaaaatgtgatgccaaggatatatctcctctgttcttccttaaagtgagatcttatctcacaactctgagacaaatttttaaaaaaggaaaaagctttgaaagttaaaggaacttgcttaaagtcacttatctagtaggtagtaaaactgaaaatctattctaattcttgcctagtctggcagttcttttaactatatggatgttatagagttgcacaagttgttcactgcacaagagtacaccaggccaagcaactaagtggggatcaaattccagcctgtgctccaccaacacatcctgaacactgttccaagtctgtatataaaatttgaagaggtgccttttccaaattcattgaaaagtcctctgataaccaagctctgcaccctcagaactttgtctccttaaaggaattgaattgttagaatttgtagaaaggtacaaagccaaatcttgaggtggccctctttatctgttgtatcttaagaacttgctgtatctaggtacacgttgatctgcttttggtaaaaagctaatgaaaactgtcccaaaatggaaagcgtgaagagagggagtggggagactactgagctagaaatttcctgtactctgttacaaatggtagttacatcctcaaattagagagtataggtaactaataataaaaattgtagtcatcctagtatgactaaaattaattactatatacatgtatatcttcaggggactggttctgaaactagatttaaaaaaatcatacccagagcatggctctagagcacatatacatagaatatgattcagatataacaaagaataaaaaatccttttctggcaccatatagggtttattttatattactataaatttatgactaaatgactatattaggctgaccttcaatatttcctgtaactttttcatcatgataaatgatgaatcataatgagaaaagtgatttcttctataatggtgtgaatatttcatttttactgaagaactataatcttcaatttcatgttgaataagaaatcataatcatatgcaacactatgcaaaagctatgaggttgtcctttattgtaccataataaaatccgaggttatcagtcatgcaactatagaagaatgtgcatcttcttttctatttaagacacgcttctgtgtttctccgaattttcatgactattattaaatactgacctatacacatagataaatatgcatagtgatcaaataattgggcataaaaatacacctaaaatgtaaactttagatttatgctattttaaatttttcatattctctttactaatactaatactctttactaatactaattaggctagaatctccataaccaaccaccactggaaattatactaatccttgggaatataagaaggactaaggagaccatcctttaggaagcacactcctgactaaatttggctgtccctctaacttgctttggccaatagaatgcaaacaggtgtgatatgagcagggatcttaaaatgcgcttatgcgacttggtggacttcctgcacttctgccatctgccatgagaggaccattccttgtaagataaaaatgcataaagcagctataaactcaagttgtagcctgaggtcaagcccaaacaatctatagcagaaagagaagctgcctccctctctgtctccctccctctcttccttccttttgctatcagagtgtgcttttctaatgatggaccaaaagggtggaaattgaagctagtactgccttgggactttaactaggaactaacatgctgtcacttacaccctttggttaaataagccttgtaacaaaactcaacatcactgggatggggaaatagaaactctcactttcatacattgtgaagtcacatgataggaggcagtaaataactgagaacatcatacaatccactgaaaccttttactaggaaaagaaattactgtgcctcatttttcaaggctaaggcagcaccccaggcccagatatgtgggcatatgacctgtgaaatcacacagggcccccatactttcaagggccttgcacttggtttaatgctctgctgtcaccatttttaaagtcttaacatttttatcaaggagcttaaatttatcattttgggctgagtcctgcaaataatgtaaatagatctgtcactattcatccctccccttccttctgtccaccctttctcttttgtgtactgggctctgtggttggtgctggggagatggtaaaaatgattaacaaggacttcacttttctatacgtaccagatgctatttatcatcacagataaaataacgactcttgagccatgctgtctgggattaaatttccttctgtcactcttcacctgtgtgacattgggaaatttacttaacttctttgtgctctagattactgttaatataacagggataatgtaattatagcctctacttcatagggcagtagtaagggttggatgcattaataaatataatacagagctggacacacagtgtgcaaaatataaataatgacagcattatcagcactattgttactattttgttctcaaaaaatatacttacttttatctcctttaacctcctctcaggcactgtacccatcatcctgtattttttatatttagtttctccctctttactggctgttctcccactgcctatgcattggcttaactcttaaggaagtttgtgtaaggatattttcctatctacttatatagttgagtgacttattccctgaggtatactgtgttttaaaatactgtgtttttttttaatttttgaaacattatatatgctgcttttaacaactacctttagaaaaatcctacatgttactgtctgatatacatggtaattaatctcaactctaaaatggacctattcatgctctctaaagtatactttaatacatgtataagtagagggacttctaactctaacactagaagataagtctaagaattcagaaaagaaaagaaatgaggggcaggctatcctagagacactttcttaagtagccttaatctgttaaaatatacctaattattgaattttattcttgttctaattgttttaaataatcacaatatctgtaagtacagaagagaacagaaagcacagcattaaaaataaaaacatattttagcatagaagaaactattcttcaatagtaatttttacatagaaaaatattaaattttataacattctagactattaggggatttttttgttgtcgttttcttttattgccttgttattcaaatatcatggcataggtagtattactgcctgtgaataaaagaacatctacttccaattctaaagtaaattatgaacaacaaatcttgctaaatttataatatggtcttcataaatgtaaataacttttacattaacaacaagaaaaaaaaatcagtgtctcagagcactgactctggaactgagcagctctgccagttataagctctgctaccttgaaaagttatttaaccctgcagtacctcagttatctctaaaatagggatgataataatccatttcttatttggaggatatgaggtttaaattagttgacatatgtaaataattagaacagagcctgggaattttaattagtagctattattattacccatggaatttcacaaagggaagattactctctctctctctctctctctctctctctctatatatatatatatatatatatatatatatatatatgttagtctacatatatatatgtatgtatgtatataaaaattgaactctctattaccaagtaatgcatgtctctagtttttagattccactttaatagcatgcccattgcattgttccctcacacctgcacatactttaaaggcattacataaacataaaatatctccagtctttccattgccagtgagataaagatcaaatgatatggcccctgcactattctccatcaaatttcaatgctttcctgactgtttaggtctgttctccagcttcacaaattttcattcagtttctcaaaggcactgtatttcctcctgccacagggctttgttgcatacatgcctcaactccaatccaaactcctcccctgccaccaccgcatcatccctgttaagtgaactcttttacccttcatggcttggtttaaaagtcagctcagggaagacttaacagaaagttgccctcatccctcctccaacataggtctatgctctcaaatcatccaactacatttcctttccagcttgtatttattgcctgaataatgtttatcttgcctgatggatccatcaggctttgtaccaaaacacaacttttgcataaataggctctcacaaatatttatggagtgatatacactgaccttttattttctacatcctcaatattttgcaaatgataccatgctttcaacgtgtttcagaaaacactgaatgagctcctactgtgtgcaatgttctagactaggaacagagcagtcaacaagacacagaagtccctgctctgtgaactacattctagttgaagagtttatactcagacaactatgcctgactataagtgaaaaaatttacaagaatcaaaacagagctcagccccatagaaacaaaagtaaagacaattctttttctgattaacacaaaaagacgtgttcctaatctttctataaggttttgttaaatatttctgtgtaatgttaaacttttgaactgcttgcattgcccatgtaattatttcataggtcaggattttcatacaatcatctcaaatccttttgagatcagaccctaaaaactgttgatgaacagagcaaattaatctaacctaaaataggctaaacctgaaaatctgtcccatttcaactatttttttaaaccctttaactcatagtggaggagttttaaaaatgtcccttgtgccactggtccagtcaaatttcatatcaaaaacccaactatctaaatataatatctcttttatatacctgaatgtccctatgttttagctaggagtataatgcaagtattatagtttattttaatatagattctttcttcccagaagttcaatacacattaaataacttatcacatgagatcaggcacactgtgctatggccatagacctaccattgatccaacaaaccctcccctgggtatctatgcaaaggaaaatgaattattatatttaaaaagacacctacatttggatgtttatcacacgattcacaacaacaaagatacggaatcaatgtaagtgtccatcaatggataactggataaagaaaatagagtgtatatagacaacagaatgcttttcagccatggaaaagaataaaatcttgtcttttgcagatacatgagtggaattggaagccattattttaaataaaatgagtcagacacagaaagacaaatactgcatgttctcacaagtgggagttaaataatgtgtacacatggacatatttggttggtgcaaaagtaactgcagtttttgtaatgacaaatacgtttgcaccaacctaatagaatttagaatgacagacaatggagactcagaaaggtggggggaatgggagggagtgaatgatgggaaattccttaataggtataatatacattattccactgatggatactctgaaagccgtgacttcaccactacacaatatatccatgtaataaaattacagttgtacccccatagatttatacaaattaaagaaaaaacttaatgcatgcttttttccttataccatccttgagtatttaaacgtaacagcctttctcttcattattaaatgaggatgatttacaatcactaggagtcttgttttggccatgagaggtgaattgattacttttctttgaaaaaaattttatccataaaacttatggttttctggaactgaataagtgtttgtttcatctattttttgaacacagaacagcaagtcaatctttatttgatggattatccttcatgattgctcagtattacatttcagttacaagttagatgctgacttaaaatcaagctctttgccagaaccttattactcatttttcattgtttccactttgtttcagagactttctaactttcagagccgaaagtaaacttataaattatctatccattcatttgtaatcaagttttctttcaatttttgatagtactttttagcaagactaggatacataatataattttcaatggataaaagtcaagggacaataaaatatttgtgcctacattatatatcttctttagagagaaactgaaaacagtattgagaagtcatttaaacttggaccatctaagatttgaaatgtgcaccttctttagctgctaataccttttttttttaagtaggaaattttcatttgctgaaattctgcaatttgaaattatttgtttctcttttatttaatactcactgagttcagtacatttacaactttttttttcatgtgcttggcataacttctgttcttggctatgtccccaaacttctgtaacaatggatcaggtctttaagtccttttaaactgaagtaaaaatagtttcttgacattcatgctttgtcagtaatgaattgcctttttttaggggagaaataaattttctagttgatctattgtaagacaggccagctcatccatatttgggcaggaaatatacttgaacttaattttagaaaactgagaattaatgagtgatataatatctccatgagaactccttaccctggtacatgagaaagccaatctaaccaaacaaacattaaggtatacttcttatatactcgatgatggctatacatgtatttattctgatgtgtctacaggagacgtcaaatagagattgctctctgtggactctggtttcactctaactcatagcctctagcaaagcctatcccctggcttggaatagaacctgggaaagaagtatgcacttctctgctacagaagaagttgtaaggttgagcatgaatgttcagaaactcctgtctgcattaccaaaaagtaatggagttttaggtaaaaactccaaggctcaggtagtttcaggttgagttcccattaggattttgacatgaaactgttatatttttaatatctggtgaaggagaacaccacttttctgagaaatgttccctcaatagaagaattctacttttaaaaaatgttgcctacctatctctgaaaacacacagtcgatggtagcagaggttctgtagctgtggaagaggacctagtgcttagaggaaaggcacccagtatagacacaaagtttgcaaaaatccaaaatgcccacggaacacctgccagtcaatttttagttgtgaagaattatgtttatataatttattacaattggcaccatttaccaattccttttcatgtattttattataagcaaataactcacaagcatttgaaaactttgacctgtatgattattaatgtcctccatctgcatagtccaatgttcaccactagtcatatgtgactgagcacatatattgtggcaagtgtgaatgaagaactaaaattgtatttttaaacttttaattaatttaaatataaatataataatttagctattggaagaattttaaacacgttaccaacaatttgtgtatgtggtctcctttttcatatgtaaattttatgaaatttaaatacaaacaaagtatttgtgatgacaatttagcatgtagatttaaatgttcattaatgtaaaatacataccagtttacaaatatttagaataaaacaaaaatgtaatatgtcattaatgtttttatactgttaaacatttaaatgagaataattttgacatattggattaaataaaatatgtttttaaattaatccaaacaattcctttttatgttttttagtgtagctactagaaattttaaaactaaacatgtggtttatgttatatttctaataaatggagccaccttagacaataataaatcatgtactctgtcaaatggtagagttccagatttaaacattttatgttagttcaaaattataatatcactttcaaccagtcagttagatcacttataccaaagcaaattggtggttcaatttctaaaattcttgtaattgcttacaaagcattttaggaggctaacgtattttcaaataaacatttgggggacctagttattctctcatcttttcccatggctcattttgttggcttacacagacataattctacaaactctacagcacaaatctattttgtaacatctcccatttcaccatggaagacatacttaaccacttaaatccttctgtaattatattatcaggtaacctatgtcattagttctcttgcctatagaaagatagaaccctcctgatttgagacatcctaagcatattctgccaaggaaatgtcatctgaacacactattttccacaaagaaagatggaaaattgctcaaatgttcttttcaaactactcattacccttaaattagtttatagtgggtaaaaataaatagcaataattttaaaaataagatactcttccaatctaaaagctatgacttaggttgaatttaagaattgaattaaagcatagcaatagctctccaaatacaatgttgccagatgctgactttgagaaatggagtaataaaatatctgagctctcctccagatgatttagtagggtccccttaaaaaaagttcatgtcacaattaattgctccctagttgggcaagacacaaggtggttcagaaagagatgatgtattgcttatgctccatttttaatttatatgaatagctgaacagatgccaggaaaaagtatatttatgcatcaagataatttgtttttttaaaaggtctagaaaattaaccaagcatttttgcaaaactttcaaaaaagaaaacgtagtcaaaggcaagtacaaaaagaaatggatatatttcatgctagcaaaaactaattcaaaacttctaaaaataggtacagattgaacaacataaaacatatgggagactctcactcagtagatccctatgaaaacacaacaatgttttccaaactactgaagcaggtgagtcaagaaaactgcttaccggcacaggttttaaaagaacaatatttgttttgctgttgttttaaaaactgatgcttatataaatttcgtttattcttttagtcattcatttcattcatttatttctactcttttcccttaaatctctatatcaggagtcatcaaactttttttttcttttttttttttttttttgaaatggagtctcgctctgtctcccaggctggagtgcagtggtgcagtgttgcgatcttggctcactgcaacctccgcctcccgggttcaagcgattcccctgcctcagcctcccgcaaacttttttaaataataaacattttaggtttgaggttcttattgtctctgttaatattactcctctgccatcatagcacaaatgcagccagtgacgatacatgaaagaatgggcttggctgtgtcccaataaaactttatttacaaaatggactatgagagatgttcagatcctagagtcacagctggctcaccccgatctatattttgaacaactgaccttgtcaatttaatttttattatcataatattttcttgagtattctcctgaggtagatgagtacagtgtacatttttagttttgcctgcttgactttcattcctttttttctgttaatagatgttccttggggaatcctgctttcaacttttatccattttaaatagctattggagttaactcagggatgacaagatgaagcaaccaggacatcagaaccagtaatgctaactgcaggatttttgtgaaactctttggagaaaaagttcatcctctttctactagaaactaataagatgtatgtctagagccaccgataatcatcatgtttctgtatcaggacagcctatatgagaatgtccaacacagaaccaagagatggactgagactcaatcctgatggcatattacttaatctcctggatccacctgtgtttgaagtcagaatcatttcaattgcataaaagaatgcattctctttttgtctgaattagtttaaatttttttctgcctcttgcatgcaacaagtactaaaaaaaaattgagaaattaccataatatcttaagccttctaagtcctagctctgggattcaaacttcccaggtaagccttgacttcttcatctatatatttaggaggccagagatagtaacattgtgtccttttgtccacatgttctgtcctaggcagagttaattatatgaataaaaggaaaacagtaagactgtaaagctattcacatctcatcaaatatgatgccctgtttgtatctgttcttccattggaaaagttactcatctcacactgctctaaataatttcaaaccttgcattatgaaggagaagacaaaaactgaatatgtataagtggaaagaaatgctatggtccatttgagaatacctaattaacatttccagcaaattttgcttttaattttattataatgctttgtgctcacatcattattacagtaactaaacccagctgactttgctattgaacttcttaacataaatatacgtaactatattttggcttttctctgataatctcagatacatactattagtttctatagacaagtcaggatgaagattaattttggagaaaaattctagtcacattaaagtctaaaatctaataggagtaattcttgcatttgatttcacatattatacaagtctatcttttaacaaccattatattcatcttctttcccaatattaagctgtattttccttgaaggtagagaggtatatcactagtttttgcccttgcaggaactatcatagtttctatcatgtagaaaggagtcagcatccatttaattgaattattttttatgagacacattcatattttttttgcctgcatccatattataaagacttggaaggcaagcactaaccattttaaatgaatgagataaacaccctccttatctcctgccagtatgttgctgtttcattcagtttccccagtaatagaccagagatggtctagattcaattccaggtactggaagcaatggtgaaacagaggaaaatgtaaaaaaagcaatggtgagggagaaaagtggtccatgaaaggaaacacagtcagtaaacagagtgattattaagctaatgaagagggtgacctgagcttaattccactgagccaaactttggaaaaggtggtaaatacatttcagggaattttaccacttgaagcatggaagctagagtatttatacagcaagtccctgcagtcattgcttgagggctgatccatagggaggtaatttcctctcatttctactctccttgttccaggaaaagcctttaagtatagaaatggtatgggagctgggcattagcctgggcaccccaaaatcttgggcctgagggattcaggtggtgcactaacagagggcctgctgtatccatcttgcctctcctttttccacctgtgctgtgcaatattctaaaaaataattattaaaaaatctaacttactaagcttccttattcaaaaaccttcaatgagtctcactttggttttatgaaatctaaaatcttccctggattatcctttttttgtcttctatgttcctctgtggcaaaaaaaaaaaaaaacacctgttcgaaaataaataaccgaatttcagatgcatgtctgtttggattaaagaagcatacactgaaacatattagtgactttccaatgtggtaggtttctctccttgtccatggtacccagagaattcaccaacacacagaaggtctccaatttctactgaaggcataagtatcataatattttcaaactatttaaagtaccatcaaaacttgtacaagattcatacatctagtgtttgttgagcaatgttacacttgaaacctctttcgtgctttgttaaataaaaatcatatttaattacctcttggattatggaaataaagaagtttattcaattattattttaataaacataattcctacttaagatacctaacagcactagtccataatcctaatgaacattgctaataatagcctgacattttaactatattatagcccccttttctcttctctttactatataatgtaacattccttttaagagctgaataatattcttaacttctactgccaaatttataaacatgtcttgctacaattatttataaagaataacagcttgctttcccaagcaggcttcttgaggcaacagtgcatcggatttttccgcaggcttgtgctgtagaaacttcatggtctagaggagtttaattgacaatagccgttccatgtgtgttctctggccctgcttgacctgaagcagcttgtttctccttccaagagctagaggttatggtggattgtaatgaattgatctagcaagtattaatagatcaaccagctatccctctaatctaacagtagtaatccacttaaccatctgctgactcaagtaggacacgattcattattgaagaaaataatgttttgtgagtcacattttaaaatacatttttggtgacaaacataattgtgggccattttgaaaaatgaagcaagcatatttctttaaatataaattccatttttaaatggaattctgttcacatatctccagtcatctttctgtgaatatagataaatagaataatattaaacaccacgttgttatctgacctaattttttctcttcgtacaccaccaacactcttccatgtcagtaaatacagctcacatcatttcaatgactgcatattatttcatagtataggtataccttattcatttaaatgttcacttttgatgtttatattgcatgcaatattatagatttgtaaaggtacaaatatcttagcaaatacttttgattaacttaaaaatagataggtaatttactatgtgccagcaactgttccaaaaactttatcaatattaacttgcttaatccttataacagctctacgaggtagatactactctttatttatttctacaaatgaagaaactgagttgcagagaggctaggtaagtaattcaaagttacacatgtactatatgaaagatcttgttgtctaacccaggcatcctcacctcaagatttgttctcttacccactgtagtaagttagcttaaggtatttatgtctcaatattatgctttacatttagttattatattaaattcctaaaaatcttatgcctactatcaaccattccaccagaatatctgaaccaatttacaatgcctccagcaatccatgcccagaataacattaatatttattatgaaacttttatttcttgacatactgactggtggcagaggctacttcatacaattttaatttctacttttttactttctagtgaggttgagtattctttgatatatctagtagtcactttagatgggtatgctgttgagataaatgagcaccagtagcatggttttgcatccacttaaaagatttagtacaatcatatgcatataactatacttaaacttctaaatcttgcatatagttcaaccataggccaatcatttatttgatgatccacagagatgaataaagtttagtcttaaaataacaaaaagaatattactaaaattatagcattctattatctagcttttttaaaaatagtgatcctcatattatgcaacttttaaatctgcatacaaaaatattccatggacacatgttttctacctctaatttgaatattcaccctgttcactcatactctagcccagcattgttcaatagaaatataaagtgaactatataggcaattttaaattttctagtagccacattaaaaacaggaagagtgacatgtaaagttagttttaatgaaataatttacttatcatttaaacatataatcaatataattaagttatttaaataaacatttaaccaatatgtaaattaatgatatatttttcttctttggtactgagtctttgggatccagtgtgtattttacactcatggcacatatttatttggactagccacattttaagtaatcaatagccatgtatggtcaatcacattgcattggacagcacagctctagtcctttttacctccagcatccatccctcattattttcctttaaattagctttttagggtattaaaaagatgtttatttgtcagcaaggacagatgtttccaggaaactgtatgctcttattagtgctgtttgcacatttttatctattttgactcttggcagggttttgagataataaatttatagcatcattcttcttgcagtattatctgctccaaaatctatatacaagctttggcattcttttaagacctctcattgaaaaacactaagtaatggccctaggtatgtcactaaccagctgtgtatacttgagcaacccaagctgcctgttttcatctatgtaggaaatacatagtccaagcaaaacagtgaattgggctttagttcctaagatcctttcagggatcattgctgacgataagctaggtggccctgagaaagtcactgaagttctcattttcctcatctatcaaaaggagatgatactaacctattaaaggtgatgttagaacagaagtatatatgtttactcagtattggacactcagttgcatttatcatttatgaattattgcctgcaaatttcttcatctgcaaagtgagtgttggatttgaactagaatgctctccaagatcctttccaattaaaacattaaataatttagtaaaatttatggaaacaatagcatgtggatgatagaagttaatctaaaaaaaaactaaaaagcttctgcataccaaaagaaataatcagcacaataaacaacaacctacagaatgggagaaaatattttcaatctatatatctaaaagaaggctgacatccagaatatataaagaatgcaaacagagctcaacaagaaaaagaaaacccattaaaaagtgggcaaaggacatgaacaggcatatctaaaaagaaaacatactaacaggtaacaaatatatgaaaaaatgctcaatatcactaatcaacagagaaatgcaaattaaaaccataatgatataacatctcacatcagtcagcatgacttctattaaaaaaattaaaaaaacaacagatgttggtgaggatgcagagaaaggggaattcttatacattggtgaaatgtaaattagtacaacctttatggaagacactatggagatttcttaaagagccaaagatagaactaccatttgatccagcaatctcattaccgggtatttactcaaaggaaaataaatcattttaccaaaaagacatctgccctgttatgttcatgacaacagtattcacaatagcaaagtcatggaatcaacctgagtgtctgccagaggatgattagattcagaatgtggtgtgcataggttacacacacacacaccatgggattctatgcagccataaaaaatgaaataatgtctttgcagcaacatggatggagctcggggccattatccttagtgaaatgactcacaaaccaaaattcaaaaaccacatgttctcacttgggagctaaacaatgggtacacacggacatacagagtagaataatagatattagagattccaaatggtgggagggtagaaggagagtgatagaagaaataccatctattgggagcaatgtacattattcaagtgataggtgcactaaaagcccagatttcaccactacacagtatatccacataacacaactgcacttatagccctaaatccataaaaataaaaaatgtgatttcaaaaaaagaaatatgatgtgatacaatggcccaaaaaataataaaaatgaaataaataagattttaacaattcctccctcacttctcaccataggagatggcatgttagttttgtttccttgatgggtatacaaacagcataggtattggggcaggaacagcaggtttttgtatcaggcagacattgagtagggtacttcttagaggcaacagtcagggatgatagtcaacatatttaacaactgttaaattatgggcatcaatcaatgtgaatagctgctgcacccaatcaatgtgaatagctgctgcacccaatcaaaattataagcaccaaccaatgtgaattatgttaaattatgggtgccaaccaacgtgaatcatgttaaattatgggcaccaaccaatgtgaatagctgctgtgcccaatcaaaagggaaggaagttccatgtgaaccacctattatagacacacttttgtgtcagcatgagtatcagcactggcagaaaggcaggtggtagggcaaagattgagctctgaagacttatttcatgtgtgacatcgaatccgtaacttaaactcacaacattgtgacattctcatctgtaaaatggggtatgtttgcaagatagatactacccaaagataactaattctaggataaagacattttaaacaataaatctaccaaagatatctatggtaaaaataagtttggttggaacttatcttgaacgaaaaactgaaatcatttatttcaacgaatacttaggaaaattaaaatttccctagtattcagaacaaagaataaataattgattgcttgaagaggaagaaatttgggttattttgcccaccaaaaatgtacaataacatattttccacttcagtgatgagtctgacagcacatacctacaggtcattttgaaaaacagtattatagatgttcatcagttattccaaggactgctcttaattctttgtcatttttatcattctcatttgaattcctattgttgtggattaacattatatttattttgtatttttcaaaatttactatatctgatcattggttagaaaaatcaacaatacacaggttcaagctattgtgttaaacagagagtgctgtttaaatgaaaactaactttattagtcctctcttcactagttaccatttcaatccttttaaaagtttttgcctccatgagaaacttcataactctaggcatgtggaaaacaaatacttatgtaataagaatcttgtagataaatcacttgcgaacctagtgaggaccaaataaaataatatcaattagaattagaacacagtaagagtgcaataaaagccacatgctagtaatcttccatttgatttcactgtgtagataccagtctttgaataccaagaatgcacagtaacactaggaagaaagccatgtgagtgtctcttctcttgccctctctatggtgacaatgtctctaactgccaatgagtcagctaaaaataattttttaatacctcgccatttgaccataaatagctatcctatgcaaaggcattttatggccaggcacggtggctcacacctttaataccagtactttgggaagccgaggcaagcagatctcttgaggtcaggagttcgagaccagactggccaatgtggcaaaaccctgtctctactaaaaatacaaaaattagccgggtatggtggtgcatgcctgtaataccagctactcgggaagctgaggcaggagaattgcttgaacctgggaggaggaggttgcattgagctgagatcacgccactgcactccagcctgggcaacagagtgagactccatctcaaaaaaaaaaaaagcactaaaaaataaaattaactttataattttttgtagcttacacatgttacaattccacaaatatgtataactgaaatatattcaagatctatgtactataaaattccatttgacatcttacacaatttttataccttaacaatcttcatttccttataagaatttccttataagaatcattttagtatctgtagtttatgtttgcttcatattttttaagcatctcattaaaaatcacctattattttttccttcatttcacccttggtgaatctgacgattatgcgtctttgggttgctcttctcgaggagtatctttgtggtgttctctatatttcctgaatttgaatgttggcctgtcttgctaggctagggaagatctcctggataatatcctgaagtgtgctttccaacttgattccattctccctgtcactttcaggtacaccaatcaaacgtaagtttggtcttttcacacagtcccatatttctttgaggctttgttcattccctttcattttttttctctaatcttgtcttcacgctttatttcattaagttaatcttcaatctctgatatcctttcttccgcttgattaattcggctattggtacttgtgtatgcttcacgaagttctcgtgctgtgtttttcagctccatcaggtcatttatgttcttctctaaactggttattctagttagcaattcctctaaccttttttaaaggttcttagcttccttgcattgggttacaacatgctcctttagctcagaagagtttattacccaccttctgaagcctacttctgacaatttgtcaaactcattctccatccagtttgttggttttccttttaccaatcaggcccctctgctgcaggtctgctggagtttgctggaggtccactccagaccctgtttgcctaggtatcaccagcggaggctgcagaacagcaaatattgctgcctgttccttcctctggaagcttcgtcccagagggccacccaccagatgccagctggagctttcctgtatgaggtgtctgtcgacccctgccaggaggtggtttccaatcaggaggcacaggcatcagggacccacttgaggaagcagtctgtccctttgcagagctcaagcactgtgctgggagatctactgctctcttcagagccagcaggcaggaatgtttaagtctgcaaagctgtgtccacagccaccccttcccctagttgttctgtcccagggagatgggagttttaattataagcccctgacttgggctgctgcctttcattccgttaaagtgaatgctatgaatatatggatctctattttaaaaaaccttccaaatcagagcagatggccgatttatctctaacaatattaaacataatggtattttactactatgaaattatataggcacctttcaaggttcatttttaacaaagttgcaagagtgttgggaagtgtagcttcacattaaaaaacagcaaaagaaacaaacctttgggaggaaattgtgattcagttcaccaccactattatgtcttttaaatgaactgataaacatatgcttaaacacattgctgtctaatttagttgttctttcagacaaactccacgaatgttttaaaaatcttaaccaaccacattaaaagaacggccaggattatctaagtggggaacatgcttttccatcagtgtcctattccagaactgcactcctttctggatgctctaggaaagaatctgttaccttgccttcagcagctgctagaagctgcccacaaatccagtggtgaccagctgagtattctgcataacgatcactctgactcttcttcttccatcacatctccttcaaatctcctgcctacctctttcacttacaagcatccttgtaattacattgagcccagcagataatccaggataatctccccatttcaagatttgtagcgtaatcatatctacacagtcccttttattcagggaagaacaggttcggggaaggacatggacatctttgcaggaccatttttctgcctaccacaatcagataaatgcagtgctcttatttcttctttcatgtaatcttaggtctaacaaaccatactcattttcttctaatcattaaattgatgattcagagtttaattcttgaaatactatttatttggctttcaggaccttgagaaaacaatctttctttcttttttttttttttttttttttttttggtctctctctctctctcttttcttttttttttaaacatagtctccttgcccaggctggagtacagtggcacgatctcggctcactgaaacctctgcctcccaggttcaagtgattctcctgcctcagcctcctgagtagctgggattacaggcacccaccaccacaccaagctaacttttgtgtttttagcagagataaggtttcaccatgttagccaggctagtgttgaacacctgacctcaagtgatctgcctgcttcggcttcccaaaatgtttggattacaggcatgagccaccacgcctggcagagaaaacaatctttctaatgtctgccccacattaattctaatttgtacaatttccatttccttaatttgtataccattgtactacctgtggtccatgtttgcctcatattttttaagtacctcattaaaaataacctctcaaattctgttaaagtgaatactatgaatatatggacctgcatatgaaagaaaattctcccacatcaaagcagatggcccatttatctctagcaatattaaacataatgatattttggactgtgaaattatacagacaccctttaaggttctatatacttttaaccctgcaccccctttccatatctctgtcccagaacttccattaggttcttacctttctgtgaatcaaatgcaagcgagggctgggtgcagtggctcacgcctgtaatcccagcacgtgggaaggctgaggcaggtggatcacttgaggtcaggacttcgaaaccagcctggatggcatggtgaaaccccatctctactaaaaatacaaaattaaccaggcttggtagcatgtgcctgtaattccagctacttgggaagctgaggcatgagaatcacttgaacccaggagacagaggttgctgtaagctgagattgtgccactgcactccagcctgggtgatggagtgagactcagtctcaaaaaaaaaaaaaaaaaaaagcaagtgcaaaatgcagaagtgctaggaatcctggtaaaatactccaaccatttctttctctcccaggctgctggagagaattagtggtagtcgccacaagaaatgaaggtttatacagaaatctcagacacagaaaactcagaccaattacaagaatcctccacacagccaaggagtcttctgcacatccaaaaaatacatgggaaccccagaatttgtaggtttagagggtcagctccagtgaatgcaatacaaatggagacagtgaattctgaaattacacctggttttctctaactaatgcatcttctcctttccttagactccaaatgcagcagtttttgctaaggatatgtaatctataaggccagagaacagttctgttcatgattgtaaataactaaatccaggtcacctgcaccctgcaccacatcaggtaattcagcctacacagaagttgccctgaaagcaagaaattcctttttgctattgctttcatatattgtgccacgatatattgaagaacctaaatggtggtggattttggttatttgaggttatgtatgatttttggaaggagtaaaacatctctcagtgtcatacccagtcaactaaagataaagctaagcaaacagttttgggatagaagatacctacagcataagacagtattcatttttatcctttttttttttttttttttttttttttttgagacagagtcttgctctatcacccaggctggagtgcagtggcacaatctcggctcactgcaagctctgcctcctaggttcaggttcacaccattctcctgcctcagcctcccgagtagctgggactacaggcgcctgccacaaggcccggctaattttttgtattttttagtagagacggggtttctccatgttagccaggatggtcttgatctcctgacctcatgaaccacccacctcggccttccaaaatgctgggattacaggcgtaagccaccgcacccagctatcctatggttttaaaagcagttccaaaaagaatttaaaacaccatttcaacaactgtggtacatttggggggaagaaagtaacaagcctccctgggcaagtacttttaaggatagctctcatgtagctatggggatttggttttattaaaaaccaatatatcaatgttattactgctccgtcccacccacaaatcaagataaacattttatagtctgtgttttcagtctaagatagtttaaatatgtggagtgaaatgttttaaatgaaccatttatttgatgaaaacattaccacacgtatctgcctatatagcattgtcataaattgtgcaaaacaggtatatccaatacagcaagaattttggataaatgtcatctctagtgcccaaatttgcccaacatttggtcagataagtatttaactagataaatgatttattacaacatattactaatattaaatgtacaagtacaaataatatttgtaaaatatgcaattttattctgaaataaataacaaacacaagacttaaattttaacagtttggtcctctaatggcttacatggttcatgcatgattgcaattttaaatgggttgggaatcccaacaacctgtaaattgaaaataaatttgccttctgatgatggttaaattgtaaaatctctacagactgaaaagattgacttttagactagctagaattgacttgaaactaagggaatctattactatatctaaagaaagaatgtgccaatcaaaatgttttggtggatgaacaggatgaggaaacggggttattcagccattaaagcaccaaaatctgaaaagtagaaagactaaccatggcactgcccagacaaaacactatctgagagaataggaactgcagcacagtctatggggcaggtgtagccaactgcagtcagaccattttagctccctaccattcaacattcaactcacgcaactaaactcctcttttccaattcatgaataaattcactagaattctcatgtctcttttcatatccttaaagattataattaccattatggaattaaaaatctatattctcatatcatactttttgaattatgtatccctgggaggtcacacctaggatatgaatctgttctcagtacactgaccaaaccatgtttctatgacttaaagattaaactactactaccacactgaaactactaccgagtgggagcagctcaaaaccagtggatcaggagagttgaagatttgaaggagagtggttaaagaaaggggaaaattatgtttgctgaatagaagggtaggagaaggtgggaggagaaaaggagagattttatgaggtcaaagaacaggtattgcagcggtcactgagtaattcagaatctaattgcttttcaacagtttggaccttacagaaatatgtgagaaaatataggaacaatctttttgtacagccttccctgagttcaattaattcagtcagaatgtagatcatttacttaaataccgaagtttgacaaattaaaggccaaggtgtttgaatcctggaaatacattcaattccccccaaaacatctcttaataaaaagtgagcaaacaaattgaatgcccttttcaatcatttcctattagattagtaaataaggaataagtaatgccatcacttgtgaaggttatcacctccagtatggtaattaccaaaatgaaaactggagtaaacatggaaaggaaaatagacctaggaaaatatgaaagtagaacctggtatacatccaagaaatcttatcacatattggcatggcaaaaagtggtcctttaggaaattctgatttcatttcactctaatcatatgtgatatatccaaactgaggagacagtgggtgtaaatatattgctagtattggcatctcaaacagaaagaatgcaaatatcatttccaataatccaagcaagtgtttaattatcttacaaaataaccaaaaaatgttttcaaagaatgtcttataattatatagcaaaattcttctgggggtattttttcttaaaatgttctagacaccatataacatattaaatatttttccatgtgctaaaaagatgctagcaatgagtagctcagaaacatatatcttgcctgttccctaagtcacttattcacctgcctaagttgattctgcaagtgagcgttaataaaaaaaagacagacaagcgatggttgtgatgatgattcttgttttacctatttaaaagaaaatctcattagtttggatttgcttcaagtgtgaacaaaaatggaatcagtctaaacaaaaagattctgatgataccaccattctaggttaaggtcattacaacacacacacacacacacacacacacacacacacttcagatttctaaagcaagatgaatgtcttgctatacaatgttttcttgaactgtgaaactgactattcaataaaaatctgggaataactataactatcaatatttttataaatagaagaggcacttatttatgcaaaatgattgaagtgcaacccttacttcaaaaagaatatgatgatcataggtactctaatttttttggattccattaactattgcccattctttaaaagattctattattttagatttaataggttagattgctataaatctgtttatttttctggaaacctacatatcttactgtacttattttagtttgtaaatgtcattatttgaaatgttgacttttttttatactattatctagtgtgttataaaaacattaataaaagttttctgggaattcaattggtctatcaagtataccgtataaacaaagtacttttgtaagcactgtgaggcataccaaagtgctgaacaatctatatcctttataacttactttgtgttttaaaacaaagtaatgtatgagtaaagagacaactaatgtgataatgctttatattttataaaagaaccaaccgattatctaaacataatagtctaataacccaaaatgcaagccataaatactctttgactacacatgagttttctgcatgtggcttcatagatgcagtctgagtaacaataacaagtttatgcagatacataataaaatgaacttaatgtagaatacatataagccaacttcccaaaagagcagtaatgccaaagaaacccagttttaattataaacatatattaacaggtttcctaaagtggtttccattttaacttttggaatagcaaatttaaaagatgtaacagcatcttttgctttattacacacctttgttattagtgcaacaaaagaaagaacagtgtgtaaattcctggagtacaaccaaatgagtcatctattcaatttgctttaattttctttagtaggagagtcagggaactattacaccatgtgaataaggcttacatttttaaattgtatcttcctcattgtcagtatctttctaagattttctgaatcaaataaaatggctgattcatgctacattgcatgaatatgaagttctcctattaactagcatggactgatggtttacattcctaatatgtccaaatgacttcaatatcatttttataatgcaattacatattaaaatgcatattttcacattgataatgccaacataaacaaacctgagaagtccctgttaaagttggtatgttccaattgcctgggcttatattcaaggctttgtgcatagtaattgactgcacaaacaattcatcctggaagagttcttcatgcctcttattatccccaaatcaattgacataatttataacatattctcaattaaagttaaatcagaaacctgaaacctccaactctagattggtttactatgtagctgttatcagtagcaacattttaaatatttcaaaagatactcttgaattatgggaaatacaaaacaaaataaataacttgcttagaaataataataaaaaattagtttaagatgatctatgtcacttcccaaagaacagacagaaattattttagcaacaattttatgtttttgtttttctgtttgtaaatttgacttccaaatgcatttattttttgatagcaatgagtatgtaacctatattactaactgaagaggtaatttaatgtatttattctactttaagtatatacctttataataaagtattaataacttttgtataaatatatatttacagttcctagagggaaaatctcaataatgtcattgcattttgggttggaatcttagttaattcttgtattgaaaggtataaccaaaaaattgctaattcaggctgaggcaggtcgatcaggaggtcaagagattgagaccatcatggccaacatggtgaaactctgtctctactaaaaatacaaaaattagctgtggtgtgtgcctgtagtcccagctactcgggaggctgaggcaggagaatcgcttgaactcgggaagtggaggttgcagtgagccgagatcgcgccactgcactctagcctggtgactgagcaagactctgtcaaaaaaaaaaaaaaaagagctaattcaaaaataagttatagtccatatatgattttgaaattgagctttttagaaacaaagtcaaacatgttttttctagaaacaattccataatattggctaaaatattttaaatagtgcaactgatactgtattaaaggaaatttaagttaatctcatttttgtgcacaggcattggaacctgaaaaaattgaaattttgggtcacagaaacatagcaagaggtaagatgccttattcttttagaggtgacaattttttcatgatggtgagtgactaatttaacttcttgactgtataaatttgtatggataaaaattaattttctaagccaacaacttctagatctcaactggagataaaaaaaattggagaaatcagggaaatatggggacatcagatataaatatactcattttaatatataagcattgttcatattttgatcatcgcttgggttctcacaaatcactgactatatatcaggtttgtcatcaattcttagtgtgcttgtgttcattttcaaaataattgtcatcaagcgttttcatgacatcttaatgggtacagtaaaatatacaaacacaaccaagggaagattatagaagaagtgaaattgtcactacttccaattttgcctgattctataaaggtataaaagacaaattaagattttgaagctacaaccaaaacagacaatgtaaggcagttttcaggttctgaaatcatttcctgtgtattgcttcatttttatcttgatcattacatatgccaaaaagacaagtagtggagaagctacggtctctatttttgccaaataagggaattgaggcttggaattcagaatttgcccagtcacaaggcaagtacttgttagagccagaattgtcttttgatacctaaacgaattcatattgctttggaaattgttacacagatacatgctacagatgcagagttatacaatcctatacctacatgagattgtgtatataaacaattgcagtaggtagcattccagatctccatgatcttcatcccttgatgttatacccattaaatatgtcacattacctggcaaaagggatttagcaaatacaggtaagactcctaatcagctaaccttaaaatgagaagataatcctaaatctgcacattacaattgttcttttatggggccatttatatagtaccccaaataatgttttaaattatgactttatttttaaaaattaatatattatatatacatgataaatctcacactacataaatttcatatggaatcctgcaacaggttaattttagttataaatgttgttactttagaaataggtacaaattgatacaaattagcctagcaattttctaacccgaaactttaatacctattttttaattcatccaaaccacttaattaatctcatatatatttttggtctgttctttgggaaaccatagagtgttataccaatccttaaaacatgtttgtatatttatgtcttatacttaacttaaatatcttctctaatggaaagtattgggttttgaggggttgttgctgttcgcttgttttgagaggaggaggtagcaaaaataaattatttaaaatgcaaacaattattgtatattaaaatcttaagtgcaatatgcacttattttttattcatttttgaggtatatatgatatttaaataaatttgaactgctaaaagataggaagtagtaaagagttttctgaatactaagtactgaacacagaaacaaccagccatgaactagtagattacaaaaaactttcatgctcatggccaccttcattttaaaatccagttctgttgcatagaaacttagctctaaaacaagaacatattccaattgtttttcattttaacatcctgagttccacctttaaaaaatcttccttttataccatatttacaattaagacctctaaagcaaaatgtaaaataaaaacaaccttagatattttagtagtttctgttataagttataaatcaagacacaacttatagtctatcttcagaatggaaagtaagcacatctaggtggaaagagtaaaaagaaagcagagaccacctgatgacttaggagacattaattaatattctgttacagtcaagtactccccaaatgcaataatttaaagtcagaaacataataaaaacatatatcatatcaattctaggattgctaacctttgccaatcagtgaatttttcagaacattccaggttcctatatcttgcctataccattctcttttggattgtgtctcagaataactttccccttttaacagccagaccacaattaagaaaataataataccagatgtttattgaggacctgtattgtgccagcatttgtaagcacattacatgggttatttcttttaatctctacaacagctctattagattgctattgctttatccacactcgaggaatgaggaaacaggttatgtatataacctctaaaaggtatcagggcaaataaatgtttcatccaggatccaattcctagtctatctgattagaaaaatctttctcttaaccaatacaatacaccaacatgccagaaagttatagctcaaagactgaagtctttttgataagtattttgccaaaaagtaaaaaaatatatataaaataaaataaagaaaaacaacagtttattaaccaattatttttctaaaatcagaatgtgtaccaagtattgtgctacagcactggagatactatactgtcgccaccagcaccaccaccaccgtcaccatcaccatcatcatcatgatcatcatcatatccatcatgggccacagatatggttctatgcacttaacctctattaaacccttaaaataaccttacaagtcaggctctattattatccccgttttacacatgagaaaaccaaagttagtaatccgttgaagcagaaaatgtgactcttgaaacctaggagctttactttgtctaatgcttacttctttacttcatagttaccattctctatgtagatttctgtgatctgttttgtacatttttctttcacattattctataaatatgtaactctctatgaacattttaatggtacatataatatgtgctaataaattagaaaatattgttaaactgttctattgtatcagaaatgataaattatcaaaaacggaaaggggataacaagaaagtattccactaactacgaaagactctagaaacagtatacacaaaagtacccaccaaacagatcagactgctagtaggtgagttatttcaaaacttaaggaacagaaaactcatgcagtatttaaagtgtttcagagaagaaaagctccccaagtaattctatccgtctggcattttttccaataccaagcttaataaagttagtataacatgtcatttatgaaaatagatgcaaatgtcccaacaaaaatattagcaaattacattcagatatattttaaataattatccacaatggcacaaacatataacaaaatacaatagttaaaaccaagtactactgacacactaatagagaagtagcttaataaataagtccctgaaaagatgcaaattatatcatagcatttagtgtataatacatgtttctttttctaacagttgttttaagtcatgtggggaagcacagataacagtttggtaggaaaaacaaatagcatttcttatactcttaaatataatgccaacagcagaaatcataaagggaaacacaagcatattttataaaataaatctgttttaaatttaatgactttttttttttgagacagggtcttgctctgtcacctcccaagctggaatgcagtggtgtgatcacagctcattgcagccaactttaacaacttttaacaaacatagtaagtgcaatataaaggcaaataaaatgtgagaaaacatatttgcaatacctcacttccttaatatttttgagcaatgagactgaatctcagcactcaatataaaaagggaatctgagctaggagcggtggctcatgcctgtaatcccagcactttgggaggctgaggcaggaggatcacttatggtcaggagtacaagactagcctggccaacatggtgaaaccctgtttctaccaagaatacaaaaaattagctgggcatggtggcacatgcctataatctgagctacttgggaggctgagacaggcgaatcccttgaatccaggaggcagacatttcagtgagccgagatggctccagtgcactccagccgtagatgatggagcgagactctgtctaaaaatttctaccccatcctttcaaccaactagataatttgcttgtttattttccgtttctctccattacaatataagctctatgtgagaaaagattttcagctttttgatcactgtaattttggcactcaaaacacttcttacatctgtctgagtttaataaaatgttgttgaataagtacaactataaggtgaatggattcccagaagattctgaagtaggaagcaccaagaatctgcctccctacctaggcaaaaattgcactggcagaatttgtctgatgtaactattttgaaactctggaatctattgagggcttgaaactttcagaggatgcttttttacaaaaaaattttaaagaccatcctaagaccatatgaaatcttgaaaaagaagaaccaatctggaggactcacacttccttattttaaaacttactgcaatgctacagtaatcaaaacagtgtggtctgacacgaagagagacatagaaacaaatggaatagaatagaaagctcagaaataaagtttcacatatatggtgagaggatttttgacaagcgtgccaaagccattcgatatggattgtcaatggggaaaggacaggttcttcaacaaatgttgctggtagaactgaatatccatatataaaagaatgaagttgagcacttacctacatcgtatacaaaaatgaactcaaaatagatcaaatataaatctaagatctaaaacttcaaaactctgagaagacaaaatagggtaaaaatttcacaacattagatttggcaatgatttctttgatatgacacgaaaggcacaggcaacaaaagaaaaaataagcaaattggacttataaacattaaaaagttttgtatatccaaataaactaccacagaataaaaaggcaacccacggaatgagaaaaaaaatttgcaaaacatatctgataaggaattaatatccagaatatatagagaactttaaaactcaacaacaacaaaaacaactcgattcaaaaatgggcaaaggaattgaacagatgttttcccatagaagatatacaaatggccaataaacacatgaaaagatgctcaacatcactaatagttgggaaaatgcaagtcaaaactaaaatgagataccattttacactaattaagatgactactgaaaaaataaaaacctaaaaagcataaaataaaaagtgttgtagagtatgtgcactcttggtggggatgtagaatgctatagctgctgtgaaaaacactatgaaagttcctccaaaaattaaaaatagaattaccatagaatccagcaattacatttctgggtatataacaaaggaattgaaaacagactctgaaagggatacttgtgaagccatgttcatagcagcattattcacaatagcaaaaacttagaatatatatgtatatataatatatataaacatacacacacatataaatatacacacacatataaatatacacacacaacatatgcatacatatatacatacataccacaagggaatagtatactattttgccttaaaaaggaacgacaacacaacatacacatacatacatatataaacaaaggaattctattttgccttaaaagggaagaacattctaacgtatgctacaaaacaaatgaaccttgaagacattatgctaagtgaaataagccagtctcacaaataaggtatgattccatttacatgaggtacttagagacttagagtagtcaaaatcacagaaacagaaagtaggatggtggttgtcaggggctgggaagagggagaaatggggaattattgtttaatgagtatggatggggtttctgcattacaatataaagagaattatggagatggatggtcataatgattgcacaacattataaatgtatttaatatcactaaactgtacacctaaaaacatgattgacatagtaaatttcatgttatgtgcattttactataataattaaattgaaaattaaacccccaaacgctgtatgatatgatccattttatggttaaacatatacttaaagatacttatttagctaaacaagtctcaaagtacagacgccaatatgtcatcattataccttttcatcaatgagtgtatacttgcttatgggttacaaaatacttgaaattttaaaacaaagactagaaattaactgcctttcctcaaaccaaacaacgataattgccaaagcctttttcttaacacataaacaggagcaaagtattagattttacagtttttattttatacacctttttccattctatacctttttagaaagatatgtctattttagacttttagatttagaagtggaaatcacacaattaccagggtctcaaacatgtaaattgtttcagaactattgaggcatttaagaaaggtagaaatacagttgcctaaaggggaataaatagcagtttgcagtgacatacagattgtcattacacaaacaactctaaacagagctgtttagaaggttctcagctcctcggcagacacagttcccaggtgttgtctcttcccctctgccaagtacttctgcttttagcaggtgtgactgcatggtgggaggagggaaagaagttatgcttggaggaaagttattgctgctggagctgatgggagtaactgtcagggcactgcggcaattagtagatcagagggctacctgcagctcctccatatgataattaaaaacaccactaagtactttgtttttgttgcacatacttttcctgtcaaacctggataataaaataaataaagtttactgtctagctcccatatagtattaaaagtattttattgtaatttggcaaccacagataaaacctgaatcttccttttaaactgtttataaattagacagctatggaaacagtaggtcacttaatctattcagctcttagagtttgccactactaaagtatttattgctttttaataatgtaccatttgtaccatgattcacaagtcaatgcatcagtgcatcaagtagataacaatttattaaataacttaatgggtctatcaaaggaacacatttttaacgataaaaagatgtatataccagcagagttgttcttcatgcatgcatgcatgcatgcataaagtcagaaaataaatattaactgagtgcctactatatgtaaggtaccacgtttggagctgggtatacattaaggaacagagatattcttcctgccttcatcaagcttacagtctattggaaataagataaaaaataaatgagcaaataaatgattatataactatgatttttgaaaagtgttataatatatttaataatggtacagtgacagaataataacagggaaatatgatgtgtatgtaagtgtgtgtgtgagcatgagttacttggataagatgaccagagagagattctcccaggctgtgcagtttaagctgagggatgagttagaaacagaaaatctgcaacatatagcaagagatacatatagataaaaagtatatatatatatatatatatatgtgtgtgtgtatatatatgtgtgtatatatgtatgtgtgtatatatatgtgtgtatatatatgtgtgtatatgtgtatatatatgtgtgtgtatatatatatatatatagagagagagagagagagagagagagaaagagagagagagagagaaaataatttcaagaagatcatgaatacttaaagaccccctaccaatatgaaataaaaaaagctaagggcagaaatttgtgtgttgcattattatttagtacatatgtacatgataaaaaataacaataaatagcataataatattatgtgtaagaaatgaagttaggttactccatatctgaggggaaagcatatctcatataatagaagtaagaattatactaaataaagaatgaaaaaaataagtaaaattccagtgaaggcaaatgcagcataaaattatgaaaaataatatatattctacctacatatcatttgaaaatgtgtggcctgacagaaaaaattaactagcaaaacaataaattaaacaataaaccatcacttcctatcttcttattcattccctttagaaccccaattcaaactttcagtcccaccacgatctatggatcccatcactttttgatagtactcattttattagtgccagagatgggaaaagaactttagagactatcttagtttgagatttaatgttaatttaaagattaaaaattcagaatgtagcttcaaaaattaaaaaatacagactaacgtatgtggcggtattttagggaagcacatccttggaattctcttgagtttttggcaagcctgttgaataaatatgtaggctacttggacggattccaaatgaaacaactaaaatgatgaaaggaatggcttacaaggacagattaaaggaaaaaatatgtacgacttcagcatgtcagaaactaaaaaagaaacattatggtttacaaatatttgaaacatgtaaacttgaggaaaaacaagaactttgtgtacaaggtacacaattatgagtatattaaaaggagagatgaaactattcccctggtaataatgttaattgttttacagtgagaacatttggacaaatgacccatggatgggcaagaattaaaaccgccaagcagacatattcgacattcctagtaacctaaactatgcagacttcaaaatacgtagagggccatctgaacaagataaagtaggtcagggaacaactgcagaaatcttcctatcccccagctgtgttttaaatttagaaggaattcttccgtggatttggggcttttctctgtaagtgtgctacagtgaaaagattcctcgatttggatctataagacctagttttgagtgctgattacttattctattctcagtccatgtcctcatctgtcaacagggataataaaaacgccttaggttgttgtgggttttaaaagagctgtttctatgaacacatattatatgtacttaaaagcattgatcttaatgagatacatcaattattattaagattgtaatgtgtcaaaagctgtaggatgaagacagtcaaagagaataatgcctgagactaggcaattatatatctgcattctgcttagagtaaatcggctctcctccaggataccttgcagccctcttaactggatactgtttttcctcatataacttctgggtctgaacatgtggtaccagttcctttgctgctccaggccatgtccagaacattttccctcctctctctctaaaaacgcccagttttaatttcatgtcatctttgctcctctaccattccttagtataagtactcctgatctctgaactacaccccgtcattccttaaagatttctgtttttggtttgctgtcatcctccccaacatttcttggggcacaagattttgggattttaataaccacaaagatgatttttccaacacctggccattcggtgccaattttcttccaatcatcatgtcttctaccctccctgaatcataacttctatagccatactctcatgtttgtaattaccaaaattttaattacattggaattattacgatgcctccaaaatctttttcctccaaccatcacttcctgtcttcttattcattccctttaaaacccaattcaacctttcagcccttccaggatctatagatgctatcactttttgatagtactcattttcttagtgccagagatggaaaaaagactttagaaattatcttagttcgagatttcataaagcaacaatggtgaaatcatccagataaagcaaaaatgggtgtaatcaacagagaaatttgtaagtgggtaaatacttctggaaatgcataaccacagagaccaggttgggaaaaacacataagaaggattagaaattagagtagtgaccaagagtagggtcagtaggaatgaagggtgaggaaaggtaaaagctagaaaattctggtaagagacagaaactctgagaaatttaaaatactggtagctgagtaatttcatgtgatgcgaaaatctaataaatagcattgccagtaggtacttaaaaacagagatgggaatcattaatgttgggatcttccaggaagtttaatatcagaatgttaaaagggctacaagctcatatgtgaaagtttttaaggggacgaatgatggagaagaaacaaggttctgaagccactgaggaagtaaagcatgttatgaaggttagtaatgggctccaaaggggaaagaaagtgttatgtgctaatggaaagaaagaaagtgttaatgttgagaagcaatttgaaatagtttttgaaaaagcaagcagtatgccaacctctcctttttatctcttgagtccaagaactggaaaaaaaaaaaaaagcacaactataattacctcaagtaaagtagtacagaagaaaggagtaaaaaataagttggaatcagaacatatagattcaaattgaaactacttactccttgaattccaggtcatacaacttttttgaatctcaagtccttatctgttaaattagattaagaatatgttctctgcttatgttccctaaagtagaaatgtttcctaaagtggaaaatacttatgtttcctaaagtggaaaatgcttacgaaattttaaccactcttttattattttgggggaataaatataataatgcatgtggaggtaaatttcaacagttaaacaatttacagctataccaaggaagaaaatgacgaggatgagctcatgttagatggcatatgatatggtttggctctgggtccccacccaaatattatcccaaattgcaatccccatgtgttgagggagggacctgtaatccccaagtgtccaaggagggaggtgactgaatcatggaggtggtttcccctgtgttgttcttgaatagtgagtaagttctcaggagattagatggttttataagtgtttggaagttcctccttccctattccctctcttgctgccacgtgaagaaggtccttgcttccccttcggcttccaccatgattgtaaattcctgaggcctctccagccatgtggaactgtgagtcaattaaattaaacctccttcctttataaattacccagtctcgggtatttcttttttttttttttctttttttcagacggagtctctctctgtcaccaagctgaagtgcaatggcatgatctcggctcactgcaacttctgcctcccaggttcaagcaattctgctgcctcagcctcctgagtagctgggactacaggcacacaccaccacgcccagctattttttgtatttttagtagagaaagggtttcatcatgttggccaggatggtctcgatctcttgacctcgtgacccgcccacttcagtctcccaaagtgctgggattacaggcatgtgccactgcgcccagccttcgagtatttctttatagcagtgtgaaaatggaataatacagcataattctcattgttttgtaaaatacttaaaatgattgcagtttgaagtttttttaaaaaaataaaccatattttggttgaataattcttcacataaaccagaaaaaaaaatattctaattgatgtggtttgagattatttggtgcttttgtttggctaaaacttcttaatggggttatgtggaaataaaattaaatgaggatgagatgtaaggcaaattaaatatcttcattacactaggagaaataaaaaccttgttaacctctaaagtcactttgtactacctgatgtatctgaaaattacagagaaagcatgcttctacacatcacattgaatagcaatgaaacaatgtagaggagcaatgaaatcctagaaaattaaaataaatcaaaaaattgtgctgaaatcaaactaaatggcaagatttaaagaaaatgtatttcaaaccacttcccaagtgctcatcttcttaccagtgatgcattctaacacattaacactttctgaccaaatgaatgagcatactcttttatttctgaatgtgaaaaaagaactttacactttaccaacctaaatttgaaatttttaaattattgtcccaagagaataagtataatttaatccttctaaaataattactagtgaaataatggttagacataatgtgtgttttacaaataataaaatcatttaacaaaatatctccatgatatacaagatgtgtcactcactgagacagagcatcgcctaatagttaagaggacaagctctagatcctaattttaacatgctacttagtagctctatgatctctatatctccattttctcatttatatttcaataataatagcacctgcctcaatagttttgagaattaaagatgataattagaacagtggaacacatagtatgcagtcaatacatgttagacttgaaagatattagaaagaatgtaccttgttaacttatctaagactcttaatgctgacatgatggtggtccctaagtaatgaaaagaaagcaaaaaaaataaaaacacaaaatgatgcctgaaaaattactgtttctaggccaaaatcaaatttagtcagaaatgtcagaaccttgcacctaaaaaagggaaaaatcacttagaagcagcttttcttttaattgaaggttcataacaaacacagttaagtactttatatcctgcctgcacttgaatattatattatcaacagtgctcttgcaggagtgttgagaaatattttcaaagtaggctcattctacaacacacattataaggaatagttatgtaagaaagtgaaaaacacagcttttaaagttcctgaaactactttgacctatttttatatataagagacacactgctgtttaaaatgtgcaagtacgtttacaggcaaactgatgggggtgggtagctacattcaattcagtatatattaagtgtctgtttgggtcttcttgtttgttttgcctggtactattctaagccctagctcagtagaaagcacaaaacatgaaacaagaacttggtatataaacattaaagcactgcgaatggtaatttggtttttgtttgtctgtaaacaacattccagaaaagttagcgtttataatacagaagttaaactatagaaagataaataaacagaaaaaatagcatagttaaaattaaagttcatatagtatttggaaagaaaatgtgataaagagtgcagcagaggccgggcgcggtggctcacgcctgtaatcccagcactttgggaggccaaggcgggtggatcacgaggtcaggagattgagaccaccctggctaacacggtgaaaccccgtctctactaaaaatacagaaaaattagccgagcctgtagtcccagctattcaggaggctgaggcaggagaatggtgtgaacccgggaggcggagcttgcagtgagttgagatcgcgccactgcactgcagcctgggtagcgagactccgtctcaaaaaaaaaaaaaaaaaaagagtgaagcagagatgtgagcacagacctaaggctcaggcctgtaggtgggagactgctctacattacagagagggatctgtccatttatttcaaataaaaaatattctccaatgtttccactcaattgttttggactttcctgattgtgtcatgagcccatttcatcctggctgacctcaaataatccccagaatcagtaaaatctaaatggttcccctgacctaaaatacaagaggggatttaaaggattattttgcattcccaaaatataccactttgttaaataccaagcacaaaccttaaggaatgcatggtggcctaaccccatttagagattatcatcttcaaatcaagcatatatcatctaacaagagattaaaaccttggtcttcccatttatgaaatattatatcatattaaattattttaagagatcaatcattttgatacaaacctgttttggaaaagataaaaggcaaagctaagtcaatcttctttctccatagtaacaaccacattcaaaagtgctttagtgcttaaaaagccgtcacctaaattcttgtacttaaatcctccattctaagtcacacactataaatctgaacaattcctacacagttactatcactataataatgcatattttaaaacaaaatagcagcacattttctaaaatataaccaaataattgcaggacattttatctacattgtaaggtctacttcttttttacaaaattcagttttgtgtcttctaaaactttattaccttagaagaaaaataattttaaaataccaacattttatttgacacaacgggaaaagtcttaaataagtacattgttcagatatctagctatttcaccattaagcaggttttcaagcttaaacatttttgaccaagtctttttttaaataatgtatacatttcactgcatttgcacccaaaaaatgttgaacatcttgcagtgaggctttctctaggtcgcaaaaccagcattatcaccagttattgcattctcttatatggtgatacacttaccactccccaccccaaaccctcccaactgcatgtacccagttttttgtactgcaaagtatcactgcttttacatatactattcgagtctcctctttgtctaaaagttggcatgttttactgctctgattaagcctgacctattacttcatatgcttttcactttctggattcagtttatagaggacccagaaacttgaaagccaagagaaataagcttttctatgatacatgatctaagacctaactatgacatctatttttgtggtcagaagtttctgattctttatcctaggttctcagctatgtggtatgtggatgaagcttcaaggcaagtggcttctccacaagtgaagtggatataaattactgtatacttgatagctttaggcaggacagtgtgatcaaatcaaggtgtaaaatcctgagttgctccatgatttagatcccaatttatttccacttatgttttaaacttcaggtttggtaggcagaggtttgacattatcatcttccttttctttcctcacaaaaagataagttacaagtttcacaacgtttcaaaggtttgcaatcttttaataatgatgacaaaatatcactatcaattttacagtagatgttgtgtcctatttgccatataacaaggaaatgagggaggaggggagaggaggagaaagagacggaatgaaggagagagaaatttttatcctaggagaactctgacacagaaagaatgccactggaaaccgactatttggcacaatgtcagtgactgtataaaaaagctccttaaaagggtataatggtgaatctgtaacatagttttgagggctacatcagcagatgctggaactacaagttatcagttaaaggtcaattgcaatcaaaataaattagttcaagtccctgacatcaattgatgcagaggagtcacatatatagaaattaataactggcttaaatgggatataacaaagctttatttatcatgacatttgtctcttttggccacatgacttgttttatgtagaatcttgcaagatctaaaaaacatacactttaccataatgacaaaaagagtaaataaaagcattcatctctttccagtgcagtagatgcataggaatagttgagtgtgtatgtctgtgtaaatcaatataacagaactgctatttatgaaacttatagttcatatgaagaataagcttagaaatcgtggtataaatttcattaataattgttttactacaaacacctcatagctctctgtgtttttccttggaaggtacttagaagactccctctaaagtaatagttcaacctaagtgtgcacttgaatgtctgtgtttccaagttaaaatcctatggtagaaggattctaccttacaatgccctctttttttcttcctcagggaagcaatgaaaactaactaataacattagtttcgtaaagagtagaaagttactttatgtggatctgcagattcacatttatgacttgacttcttttatttttccttttattttattttttcctttaaaagatcttcgttgattatcctgacatctgctggtgagggcacagttgattctagtctacttttcccttcaacaacttgctcaaatcaaagatttttaggggtattttcagtgacaagtggtaatacattcagtttaagtatttatagtacttaaattcttgctgtatcacataggaaaccatgagaaatattttaataattacttcacattggcagtcatttgactctgtctataaatacatgtttgctttgattaagcaaacaacattataatcattacatggactatgataaaaataaaaaaatcattttagaagaatatttatatagtctataactatagaacatctaaggaagatgctaagcgtcttccttaaaacacagagaagaactgaataataggaatggcttagctttggttttctgctttttaaaataataatgttaattttcaacctacttagcaaataaaaagtaaatgattaactatgacagaagccattaacactcaacacatatttgcaaaatttgctattttttactcagtatccaaatgttatgatttacttctgacttgaactgagttctgaagcctgcactgtttctttggaagagatacaatgaacctattacatcctaatcttactcaaagctattgcacctgcaagtgtgtgcagtaaacaacaaatatcagaattacttttttaggcttcaagaaactctcaaaggaggcaacttttaaaaaattatacactaaatgataatatatacagttcatcccattatgcaaaatccttcaaaaatgaaaagttttagctaattaaaactttatcttgaaattaataaaattaacagctggtactactaatttaactctaaaaactgtcaagcttttacttttaatggtatcgagtgaccatgctactttattttagtcatgtatatcttattccttccctttacattgctataattttattagaagaaaaaaatcacatgtatctagagagaaaagcaaactttattaaatatttatttaaaataccctagattttgaatacatgatttatatgaacattgatgtcaatatatttgagaaaattatgacatagttttaatttagaaaagtattcagaaatacatttgcctacttttgaagatttttgcaacttcaagatcaaagaaggaaaaatagaccatctcaattttttcctgatttttaaaaattattttaagtcttttcccaaaaccatatacatttaaaacaaatacattttaattctaaggaaacatttcaggaaaaatcagaaaaacattttcagaaccagaggaaaaaattgtgtgttgtatcaccacagtggccaaaatattgcaatactgtcaaactttcacatgagaatacttcattttcacttaattcttattttaatttgatatttcagaattatttttgtatgttttaccttgactctgaagttagcatttatttttaaggtataaaatttaatggtcaggtaaattaggcaacgaagacatcaatgtgtaataataatataataagataaaagaaactccttatttctgtataaatgtaactatactaatcataaaaggttagtgttgttatctggagtgagactgttcaggtattaatttattctcatgtaaaattaactaaaaatcgccattgattaaaaaaagaaaatgcaaatgccaatgattcatagtatttaggacatgtctagacatttttagacagtgccatttgcttaaagacttcaggcacaaactgcaggcacagggacagattgcataagatgtcacgtgcttgctgcaactgtatgcatgttattgaattttttagagcaacccataccgtgaataatttaatagttaataaaatattcaatctgactgatccattggtttaattttaaaataaagacgactaataaaaggagttacatatccttatcaaatcccaggcattaatgcaagtaaattgcaacccatacgtagggaaaacaccaatttctaagagacatgagattaatgattgggggcgggaaggagtgcaaggaaaattctgtgttagcactggcttcaataagtttgccggaagtttaattgtttggagctgtcacggaagctgtactctgccttctgcagaggtgagggagaaaaaattagagaggtgcaagttttaacagaaagggctaatgcaaaatggtctatttatttttcctcaagcctttcccctgtcctcacaagctagctgggggaaaaagggagaaatctcctgaagaatatggagcatccagcttcccgagcattgtctaagagaaccaggatggagagtccaggcaacatctccatggttggcttgtctggcggagtaagctgtgccctcggcgcgggtatcttcaggagacagagctcctggctgcagcgagccgggacttgccgcgccccggggctccctcaatcagacccagccaggcaagcgcggccacataggcaagcgcggccacataggctagacgcactatcttctcctctaccccgcgccgccctccacctcggagcggggacgtacggtggtggcggtgacacaatgcgagtgagtgggtgagtgtgttttcgtgtttggggtggaaacgtaggcggggaagagaaggaggagaggggagtgcctgcagtccttcccccttcccttcctgctaagagatcaaagtgcagaggaaatccagacgggaaatgagagaaaggaaaaacagcagccgtggaagcactctcttttttatatcgctggagactcggccgagcaactactggaaccattaccatttcttaacctttagtggagtggctgcctttgcctattaactggaagggcactttgtaaacgcaggcgaggcacacacctacacacacgcctacacgctgggggaaaataaccacattctgggggacggagggaggcccaggcaaggcgcggccatggatctctactgccagagctgcgagggcatctggccagcaacacccggcttcttgggcgaacagtcgcccaagagtccacaattttcttgtgactcaaatagatggataggtgcatggatggatggtgcagaatattcatactctgtctaatctcaagtggactggagtcaacgcatttttaaatccatctaccttttttagaggcacagcatttaaaaccctgtagttcactcagctttccacttgaagctgcctgcagaggattctattacccgcggatccctcacaaggggccgcccgcatctgtgagcgcaggagtggcacagctcccccaggcacagctcccactcgcctccccacacaccctgctgcccccgctgcccttttccggcgactacttcagccccggccagcggtgagacccaggtcagcacaagggtttgtatggacaagctgcacctcgcaggggacctggaagtcgcctaaactactccagcaggacactcgtcgaagtcctgcgttttcttttaaatgcttttttctttttaatttaatttgatttttatttttctgtttttattttttcgtgcaattcacagaaggcatcaccctacaagctctcacaacttttccgctcctgtgcggggacgcgaggggtggcttgccccgcactattccccattaccaagagttaacactggtactcggagggggtgcgcagctaagctccaggcccctggggtcagactaggagaggcgggttcctggggtttgctgtaatcgatgctgctcctctgggatggggaggcaggagaaagctgaagtgacctgtgagactcctctccacctcacccgcggccaaaacgcccagcgccgggtctgggtttgcgaacggctcagcccaggccctgcgccagagcaccgcacccgggggcggacggccctgcagctccccagcctcttcccgcatcaactagctgacgcccgggcgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccgctccccaccgtcctcctctttcctgtatctcaccccggtaccccgcacccttctccccgctcggccccgcgcactctgctcagactttacaagcactttctcggggcacccaggactcgacgcctcctccgcgccgccagcggcgctcgccacccttggcacgccggagggaccgcctccggccccctgcgcggcgtttctcaggggactcccagcccatccctcacccagctgtccgggtcccgacgccttacctttgccgaactgggggacaccgaggctgagcccgaccaagagccagacggctaccgagcgcttcatgatcccgtctcccggacgtgaccccggctggtcaggggtcgtcgcggagggcagtgtagccgaggtggcagcgcagggcagcagcagactccgcccctactaaagaattcaagaagacgttctctttcctcagcgctttgttaaacaaattcttggagagggcgagagtggtgactaaagagaggagcctttcctccccttttgcctgcgctccggcgcgcggaggtgggtgagctccggggagccgccggcgggctcagccctccgctgcgggtgggtcccggcagaggcgcggcgggcggggcgcgggctcccgcggccgccccgggtctgctgcgcgggcaggcagacccaccggcagacaggcggaccgggcgctcggctgtcgctgttctccgcgcggcggctgcggggcttct

SEQ ID NO: 224 - DNA, 58477 bp, Homo sapiens
ttatcttttaaaatgtagtctgtattattttcaccaaccaaaacacacataatatattttattataaaacattagcaatgttacttttgagatatgcaatctgaaaggtcacacttgtatttattaccaggaggaaataccagaggagtcacattagaaatcaaccagacagactcgtacgtggttatcgctacttacacagcattaaatgcgggttgaagcagcacccgctccgtgtttcagacacggacttggggtgggcaaggggccctgtaagagggcttcctcctctcagtactggggctctgcgtctcacctgctcccatctccaggcccacggctgacacggtatgcacagccagggtttccagactgctctcctgctctcacagaactctgtctgctctctggactctgcccttgaaactgagacctggacatgggggagacagtcgtttccttcttggctggaaactaagtcaacaaatgaaacaaacctagtctaaattccaggataatagtaaattacctggtttataaaaatacatgtccaaaatagttacttcctgggttgtgtacaatataaattacaaaaataaaatagaaaagatgaaacagttgagcacatttttcagttctttaaccaacatcagcatttatccatagagatcagtttgaaaccatttgcgtggcaccaagaccctggcaaatctaggctcaggagagagaaccctgaagctggggtgaggtatttctgtggagccctgtggcctgtcctaggcacgctcgcctctacctggtggaagatggcctttccaggaaaccctccacaccgtcacgggctccatctgtggcaagtggctcgctgaatgcacagaggagcgagtgagcagaagggcgtctgcgggtgcctcgtcccccgtccacgtctcccggggagggagcatcacacagtgcagggcagctcgcgcattttcaacctctcccttttgtttttccttttaaagatagatttagtgaagtcttttaaaagaaagtgtattacagagaaggccattttaagatgtttagatagatagccataaaataggtgtttccgcctcaatccaagttattattaccattttgtacttgaaagtgtccaaatgacacaatataaaagaactatttcttatttcaatattaattttgctaatcaaaggttccagtttccagtgatatgaccaaccaataagatataactggtgcagagagagccatatattttacataatatttataataaactttcttatcacagttcctcctcagaacacactctacagaatgtcgactgaaaagcttccaaaataattgaacacaagatatgaatcagcaacagaataagctcaagggaagagacatgggcacaggcaggcaaaacgtgatcaccacagctccgttcctgcagtgacacttaacatactcagcatcttcatgaattctgaataatttactgatcgtaaagtctaaaagtatcaatttcaggtgagcagttttaaatcagaaaatagtcaatagttaatcatgactcttcagggtatttccttcacgtcctctgaagagtttcccagaacattcttgtgaaaaggaatgcctcccaacaatggagagcaacaatagcaacaggcatctgaatcagcctggcctctgaaaacagaccaaagaggagtttatctgctttcttccagtgaagaaagaaaatcaagaacgtggtattggccgagggaaagtgaatgagggaaggtaaataaaggacccaggccagtctgtggcaaaggaagcacttaggaaatgactgcagtgatctctagtgagcattttgtaaaattccactccaacgttaggccatggatgcaggaacctatctgccatcatatttaattaagatggagtgttacgcacctaataaagaaggtgaagttctaggtagcattttaaattcataagaagtctagaagaccaagaagaaaagagataaggtagctaggatttcaagcagcactaagcaaaacttaaaattgtatcgtgcagtaaagctgaatgtacaatcatcccagacaagacagtttaaagaaaacaagatgtccacataagtgtcttggttttagccgtgataattctcagccccaaacatcacaaatctaagaaaagctatatatttttatttattaaatagatttaattatatgtcttctgaaatacaaaagatagaataaatcatagcataaaagggaataagatatgataacatcatgatggccaattaatacacataaatcgactttttctggacagacaccaaattacttaagaggattaagagataacttcagaagcagcactacctggaagattatttggcatttaaatactgatttccaaagtgctagatgggcaagtccaagcaagcatttgtggtcacatgcacatacatctcaacagttacagatgatgagaaactgtcactagtacaatttgaaacaaattcacctactctaactgctcacctgaaatgatcttgaacaaaatctctagaagtgtggcttgcaatttttttcttcagacatattctgcctcattttatcatctaagcaggcaatcctatcaggtctgagtagggcaaggcattgtgtttcttacatgcagaacatggagtttttctatttggttccatcaactcccaagcatttcaggcccacggaggtgagagttccttcaatgctgacaggtttgctatttctaacctatcatcgacagccttcaaggggtcccgtcgaggcatcaagactgctgtctgtgtctgaggccagcgtctgctcagtggacatggatgaaatgtcattgatcgatgaagactgagaaggagtggcgttgctacttactgctgcatctgtgctaagaaaaccaaatataataaaatctgaggcacgacattgctgcaaatccaggcagcgagactgcaggccatttctcggctctgtccttttgcagtttcccaatcctaactatgagtatagacaagaagtcagtcagctggactttctgaacttttccttgagtctttctttgggccaagagtcccatattcctatgtctttccttgcaagattcttctttttttctcagtagctaaacatatatgtggccatgtataatcatgttagctacttaaaaaatacctgctgctttcaagcagacatcaaaaggacacagctatatttatctgaaaatgcagtatcacaaaagcttaagcctgactaggattccagtgtcaccagacacttgaattgtaacaatttataacataaacactaaatctacaggaaaaaaagcatcaactttcaaagaaatcttttgcaataaataaagactatataccagaaaaaggaaaaaaattagtggccttgtatattttatggttttataactccagaaaactgacattttaatcttttaaagcaaatgaaactatcctacttcctactatccatattttagtctggtttgaataaaaacacaacatgcactctctgagatcgacgtctgcagtcatacgtgtgtgctcagttaacaagcacctaagttcttgctgaagttatataatctctagatgcttgacacatacgtcatgttgaacataaaattcaagaataaaaagtaagctgtgctctctgcacatccgcacacatgtgtgtgcatgcttcccagtgggagtgggagagagacaatgatataacgtgagcgtttcatttagtaaacaggaagaatccttcagacgtaagtgaacacgactcatatcagagtctcatgatcatacaactacctggtcattagaggcttccaccactatgaagatcagtagatcaagcagaaaaatgggaaaatgatatcaacaattttctcaaaaagaataccatactccattttacttagattggcattttgggtgggaccagtacaaagggttatcaacattgaaaaggctttaaattcaatttcttcatctgtaaatggaggtgacagcagttattgcaaagatgaaagagaaatgcttataacaaagttcagtgcctggcacatcagtaaaatgtcatccaccaccaccaccactatgacaagccaaaaaggctggctattcatacagcggtttttaaatctgatgctagccaggctggcatttcacatgttgctgccatttataaaagttgaatcgggaaagacgccaggtgcggtggctcacgcctgtaaccccaccactttgggaggctgaggcgggtggatcacgaggtcaggagatcgagaccagcttggccaatatgctgaaaccccgtctctactaaaaatacaaaaattagccaggcatggtggtgcgtgcctgtaatcccaccactttgggaggctgaggcgggcagatcacaaggtcaggagatcgagaccagcttggccaatatggtgaaaccccgtctctactaaaaatacaaaaattagcagggcatggtggcgcgtgcctgtagtcccagctactcgggaggctgaggcaggagaattgcttgaacccaggaggcggaggttgcagtgagcagagatcgcgccgctgctctccagcctgggcgacagaacgaaactctgtctcaaaaaaaaaaagttgaatagggaaagaaaaatatcatacaatcaattaaagcaatcactaacctgaaggctgatcttttacaacaccattcttgcttctttcttcccaatccatgacttctttgtaaattagctctttaataaaaatacaagttaaaatgcttaatcagtttctaaacagtttcactgtatctctaaactctgcttccaaatcaactggaacaaaggcattgcgatttgttatttttaattgtaagacagagtcaattcagtaatatagtctacctggaccaaaatattcatattttgatacattatatcttttcttttcttcttcttcttttttttttttttttttttgagacagtctcatgctgtcatccaggctggagtacagtggcatggtcttgactcactgaaacctccacctcctggattcaagtgattctcatgcctcagccatccaaattgctgggattacaggtgttcaccaccatgcctggctaacttttgtagtttttgtagagacagggtttcgctatgttggctaggcttgtcttgaattcctggcctcaagccatctgccccacttggcctcccaaagtcctgggattacaggtgtgagccactgcgcctggactacattacatctttttcaatgcaactagtaaggcagcaaaacatgtagggtggttctggatccataagggggctttatgaagtggagtggctcccacagaacactgtaggggattggatattctcacacccatttgaatatgtttctctatgtggttacttggggttctccaaaggtaaccagcacccacatgtgggctaggagccccccacactggccagaaatgaatccacaggcctaagtcttttcttaatttcaacttcggttttcctcaactttcatctgtaagaaaaactaattacctacgaagtaagtgatgagggattcctaaaatgtcagtattcataaaccaacattagcacgttgcaagcattcgctgaggccagtgagcattgactgaggccagtgagcacgctgtgtgcatgcactgctgagcacgggcacacacaggtaaccggcactcccacaccccaggatggccctggggcatgaccctcatcagtgttgactgactctgactgtggttctcagttactactgatcctgcttcttaatgaaaaattgttagttcaacctcttcattacaggtatagtttgttgtgggttgtttggttaatcttatagtggtaataatacctatttgcatattttcaatctgcaatttcccccaaactagattttaaaacatatgtacaactacatggcttaaaaacatatcaatcaatataagtatgatacaattactaagctcagtttataaatcaatatgtgaaaagccatgaaaaaaatattatttttccctcttgaagcaaatgataagaaattcataaatgttcctctctaactctgttctcttcaagttcattttctactggaaactggggagaaagaggctaagtgggtcgcagggtttcttgccccttcctgaagggaaatgtcacaaaatgaaaagcctctgctctacaggattggaagaaatgtcaaaaggaaggatcaaaataagctccatctttacctttccattcttcaattgcatgttctctttcttccaactgggcatcataaatttgaggtggtggctaaaaattaaatcatatgtaaagtcaacagtaatgcctcaaaaaaaaatgaggcactaaaaaaggtaaaattgcttggaagacttctagtctatttatgatatggatttagtttaattcaacacgtggtttaataaagatttgtcatgtgatattatatcaactttagaatcaaaataattatgaaaaagttaaccaaagaagagttattatgttcctcttaataatcacctgacctcaaaacgcagacatctgcccagatgtcattagaaactcatcatcacaggctgtttcccagagacccattatggacaaggcactgtgctggcagctatggaaggtactgttgtttcttagaacaaattttacattttcttcatgggagaactcccaaatccaatgtccaactcataaatggactgttataaaagtctgcttataaattggattctttttatataaaacaatgtttaaactgatggcaaaaccacaggccatgacataaacatgtatttcactcatggcatgaaggaagcctgccactacgcagtgatttccctcacagctaaagctcactcacaccagtgctgacacagaaacacgcacgtgagcaccaaactcagagtggagctcctccagcgggggaaccaggagctacaatgcctttagggaaggataaacagacgtgtgatttttcagcaagttgctcagcctctctggttaagtggcctaaacaagaggatgtaaccaaagccaatggcacagaatagatgcttaataaactatgagctcacagcagcatttgcaaaatggagactggtagcaccaaagcggaagttcattcccgaggtactctgagctggggctccagcagcaaaagagcaagcgacccaggtctcagacaacacttggcctttctgtaactgggagcccccaaatggagaacttgctacccatatgtagccactctggacggacagacaagatccaaggaaatataagcctggcctctctatataaatcttttcaaaacagatactcacggcttctgcttcggcggggtcataccaaacagtgatgtatgggtgacgcagagcttcgtctacagagatccgcttgtcaggatcaatcactaacatttttgataacagatctctggcttgacttgctagggtgacaacaaatattaaattaatgctgttaatatgaaacaaacagaatcatacaataaagaactaaatatgacaacacagatagaacaaagatatattaattttgagaaatgtttgataggttcaagatgaatataacccaaaattttttttttttttttcggagacggagtctcgctctgtcgcccaatgcagtggcgcaatcttggctcactgcaagttccacctcccgggttcacgccattctcctacctcagcctcccaagcagctgggactacaggcgtctgccaccatgcccggataattttttgtatttttttagtagagacagggtttcactgtgttaggcaggatggtctcgatctcttgacctcgtgatccgcctgcctcagcctcccaaagtgctgggattacaggcgtgagccgccgcacccagccataacccaaacatttttaagaaaaagtcaaatgtccactttcatgacaaaccaggtttccaaatgtagttttacgcctctggatctgcaaggggaagagaaacctgggctcccagggtggtggggaagagcaccaggcagcctcagaccaatgtctgggcagggcccaaggctgggaaaccacagcaaggaaggtggcaattgccgagctgcgggtggcactgcccagagtgtgggcatgaggcacgggggagtatttttctctaagtcacatcgaaatgaaattagaacagacttttcaaaccacacaacaatctcacattcccacaggataaaacactcacagatgcttctggctggcctagctgtatacagtgctggcaacttacacttttttttttaatctacagattggtatttaggaaaaagaaaaacaagttcaataacttagttaaatataaggctcacctaggttttgtcaattaaagttcacaacctgaataagcaaagactggggcttttctgattaaggcacagtttaccttcatgcggacagaatcaaatcttttctttttccttaaacaatcacactgtagtaaagggtgcaggagaaggtggggaggaaggacctttttcatcgaacaactgtcacatcgcttctgactctagaatctgcattaagtgttcttcttacctgaaaactttttgaattccagttgctgtaactgtaacataagattctttcagactgatttgattatttttattttggccaaaggcttcaattaagccgtcttatagaggataaagcttctagacctttaagctttctctcctcagtgccttcgtacctcagacttcaggcctaaaatgactttctctcccaaaacacaggtttttagaatacaaacatgaaagagtgaaagcaccacctgaattacaaaacacaagtataagaaaaaaaggatatcttactttttattttgtctcgctcagattctgatgggaatatccaatctggaaagagttcttcaaatttgattccaggatactttggtctgttttcgacataattcctcacagttggctgaagtttcttcatgaactctgctgatggtgttcccagctgctcaataactttattccactgatcaatatctaaggagtttcttgaggaaaatacaactgaagtaccttgtattcacagtacatgcggcagcatcacttgaataatatttaaacctatcgactaggccaccccactggatcagcagcggaattttgaaataatattcaaataaggtttgggtttccaagttacactattttttaaaactctcacactctgcatcttcataaactatgatcacagtttattaaatcaacacaatgaagtctacacaccttcccactctagttcaaaataaagtttatcttataactaagaatacctatagcaaaaatgattaaacacgaaattagataaacattacataagcaaattgaaatcagttttcatactaatgctaccttagattcattcacagctctctaaagaacagaggatctcaagggacctgtggagagacctatctgacctcctcagtttacagctgggaaccaagcaactgggcttagactgagcccagcgacagctttcaaatgatgctctattttacttggaactgactcttcccaaccatcactgcgatccctaggtaatgcattttatttcctttcaaagtgcgtgacctgggtttcagactcaactctgcattaaacactcagtgtgtcaggaaagtcaggcttccttggggtctgtttccttatttgttcaatgcagacattaccagctttgcctattccacagggtgcttgttaggcttgggataattaggattacatgtgggaaagtgacactgaaactgtactcgctatacaagagaatgcaagtgagaaaaaaatagcatcaacagcagcttaaaaaagtgctcactgaggcatgtcttagaaaaatgaacttacatcaccatgaaataacctagggaactggtacatgaactcagttcttccaaaatgttatacttccaaaagacccgctcaggaaatgtgtttctggcattcaattcactagcaaattctccttcctactcctggttcatacatattgtcaaatcagaattatgcccacattttatttacctatttagccaaaatgtgaaaactgtctcacaccttttccttctgccatatatacatatataaataaagacagagtctcgctctgtcgcccaggctggagtgcagtggcatgatctcggctgactgcaacctccacctcccgggctcaagtaattctcgtgcctcagcctcccaagtagctgggactacaggcacctgccataacggtcggctaatttttgttatttttagtagagatggggtttcgccatgttggccaggctggtctggaattcctggcctcaagtgatctgcctgcctcggcctcccaaagtgctgggattataggtgtgagccactgcgcccagcccaccttatacttttgatacctcttctgcctgctcactcccacagacttcccaggatgcacccacccagcatctgtgtgccatttgccacacagcaaccatctgggctcccggctacactaagcctgctcagctctagaccctaacccccctgactcaaggacaagctccctcaactcttccttctccaacatcatcgacattttgcactctaccaatacattccaccacgttggtaaatgatggtgttttctcctatgttaacacagtagctgctttcctttggccctacctatcgctttatttcttattcctatttgcagcaaaaacttccataaagagctgtcggtcgggctcagtggctcacacctgtaatcccggcactttgggaggccgaggcaggtggatcacaaggtcaggtgttcaagaccagcctggccaagacggtgaaaccctggccctactaaaaatacaaaaattagccaggcgtggtggcgggcgcctgtaatcccagctactcgggaggctgaggcagaagaatcgcttgaacccaggaggtagaggttgcagtgagctgagatcgcatcgctgccctccagcctgggcaatggagtgagactctgtctcaaaggaaaaaaaaaaaaaaaaaaggaaagaaaaaagagctgtctacacttgtgtctctaattcccagcctctcattttctctcaaacatactcccatcaggctttcttccctccactccataaatgctgtgcccatcatggctgccagcagccatcacaaggcccaggggccaatcccccgtcctcatctcctcatgtgaatgagcctccctcagtcaccacactctaggaggaggggtcacgtgagtgccttctccatttccttccctattccctttgtccctccacctcaagggggctaagtcccgggtcctggtctcttcctcccctgcaagtgctcgctaccagtcctaggcttcaaggctaccgacagacggatgacacccactttgatctctctatcccagaccttgcccctaaattccactgtctaacagacatctccaaaccctagcaaggctccttgaagggtccagcttcaaagcagagtacaagcccatctccccggccacacccctacccgcctgctgggggcctccacctctcctctggatgatggcagcctctgctctgttctcctgctctgccctgcccttgacgatccaccctcaattcagcagctgggaggagcctctttgcatctcagtcagactaggcacccagaaatgggcaggtgagagaaatatctgctgggttaatgataaaggactagaaattaaaccagttgtgagaggagacccacagattccccgagaggactccaccccagcatcctacaggtgggagggatgggggacagatgagagggacgggggaaggggaacaataattccgacaagcccagtggaccctgttgtctaactctcgtgaagctgcaggcagaccacaggtctattttacagaaggggaaaccaaggctcagagaggccctaaatttctcaaggatgcatggctgccaaggggaggagtctgagctggggcccgaggtggccgggctaaagctttctctttctcatagaccaccgcagggacaggagttccttttctaccctgggtcgcaaattaaagcaaatctctgagaccctcagtctgatttctgcaacttttttctatctcccaaatttcaatctaatatttgaaagagttggcaaaattttctttagaaaatgatgttaaactctgtgtggcttttgggaataacattaggtaaccttatatataacactattaattactgacattaatgttcatatgtatagcaggaattttaattttacttactaaaatgcaccaaaaagtactcacatttttcatttttgtactttttgaagaaaacattttgtaataaaacaaggaatggcacaaaatgagtaagaattgagacaaactgaacattaagtagatatttctaaattattagtcttttaatttttcaacttttccctttttaattaagtttacttgcaaaataaagacgtccttatttataggttgcaacaagtgaatctgagatgaggctatggaaactgctagaaaatttagtagaacaaataaaataacttgacatattatataatctatgatatagaaaatgtaaagaaaggtaaataaaatgagagaaataaaaatattttcactttaagtttgcactgtgaagaatttataaggagaccactttgataaaattattaaaatctgaaattattttcctaagatacatacaaaacactgactatggagcttgatttccttaaaagcaaccatcaatctgcccaaggatggagaccaatttaaactttcataacgaaaacaaagtcaaagactaatgaaaaactaagtggttaaaacacaaatgaaaaagggaagatgtgaagaaccatgttagggtaaaaaatactgaggatggaagaatggcaaatgaggaaagaaggctattgtaacaattagagtagttattctcctttctgctgtatctctaacatgacttgctgactacagtatgagtttatctctttcattttacatttattttgacttccccagtgtgtcacaaaataacccactagacagatttttaaaaaaaattctacaaaatgtcagcacagtaacaaacaagaaagtttaacatattgttcctcacaaaattttcattttaatctctttcacttaggtcctttgtaatgtgcttcagttcttactttgggggaaaatatttcaatgcataccagtaactaacaaaatagtacttaattaaagcacacaagcacactagcctattaaatttagatagcatctttcctagttaaattaacggaataaactaaataatacagtattttcatttaaatatcagaatatacttatcaaagagtaaataatttcttctatgtgtccagctatttttggcaaaattaagagctaatataatcggtttaactgaactctaagtctcaaagtcatcacaggtagtcaagttaaaaataaagaatgaaattgaaccacttggcttgtgacactaattaacaaatacagtaaagccccccttagaacacagtctggagtggattttacgactttgtcctcgtgagcgctcgtgtaagcaggtggtcatgctgcctgaggcattaagaaagcatggcggggccaaggtcgcggggaaggatacggtcagtgccttggaatatcacacaacctttcaccagctctcccatgatgcaacccactgaccagatatcaactgaaaataaaatgaaatgataaaattatgaagtgccatgaacaaaacaaaagtgaggaaaaggaattctaacagtgcactaaacacacaaatatggaaaaataaattgctagctaagggtgacattttacacaatatgaatgattgctgacctctattttagccttcggtttgtagcaatctggggttttagtgccaaagagtccaatactttatagcttaaaacaaacaaacaaacaaacaaaaaaccagaaacaagaagtgcctgtgaacacaaagcttttcagggccacacgcccaccccagcctccatggccaagtaccgggtcccctgtgaaggatacagtctcttcccgggaacaggactttatggaggaccatttctgccatgatgcacccgacagaccagatgtccactaccaaacaccaggggattaaaaaccagctagagtcccccatcttttttcttcaaaccccctcccaggacaaacccggtacacgtcactagcttgccggcgggagcctctgtgcgttgttgataccacacctcctgagcgatcattttctagactgccccgtcagaaaggcagcagcactcactggcggcacaggctggctggcttgcaggactgcaggtgaggccctgctagaggggcccagacttccacggtgcccaccctcatctgtggggcctcagacagacagcagaggcctctaagtgccctgctggcgggccgaggggagaagtgaacaggggatcaagttttctctcccctccacaggaagcacatgaagctgtgcccctcagggtgggaacacaagctacaacgcagcaagatgaacctgtagcaaaactcatttcagatgacccgggcaaactttcagtctttttaaaaataagtaagcgtgatttcgttattttcaacaaatttgctaaaagccaagtttcaaagagctctgatattgctagaataagctaagttttgatgtaaaaagacaccaattttacatgaaaacatgtgttattctatttacatcaaattcaaaaaaacaatatgcagaccaacaaataaagctgatccatggtactggagatcaggagattggccagcctcgtgggctgcgaggaggggccatggggaggccagagctgctgctgctgtgggtgtgctcacctcagctgagctgcacactcaggatttgcacacttggctatagacagcttaactctgattaaaaagttcaaaaataacaattttaaaagtgaatttttaaaagagaatgattttaaccaatggaaaaacacaattaattatttcttatctctggatcatgctatattctgggtgtaacagtccccacagtatatatcatatggttcaaaggaaagagaaaaaactcgagaccaccgctagagcaatttctaaacatcccagcctcttccagccccggctatactcaccgttctctttgtagcccatacccaggatgacttcgggcgcccggtagtaccgtgtcaccacgtaaggggtcatcatgaagttagtgcacgctgtccgggccaggccaaagtcaaggatcttcagggtgcagtctgatttcacaacaatgttgctaggcttcaaatcctaggaaagaaatggcttaaattagtaaaatgaatgaagcatgctaaataaactacttcacatccgtgagggtcgtgaagccagtgtgagagtgtagggagtgaactgaactctgagatttgggaacaactttggaaaatcttactctcaaattgaaactaaaacaaatcagcctaaagccgtcagatggtgccccttacccccagtggaaaccttcatggcccccatttgccctttctgtggtctcgcaggccctcaggctgtcctatctaccctccatccatgcatctacacgtccagcacacatgcccccctcccgctctccacgcctggacttgagttccccaatactctgactctctcttgctaaggtcctcatgctgtcagtccagcacacacggccccctcctgctctccacgcctggacttgagttccccaatactctgactctctcttgctaaggtcctcatgctgtctgtcagtccagggcagtgctgtcccacagacaatgtcatataatgcgaacgatgtgtataatttacattttctactagccatgctcaacagcatgcagaaataggtgaaattaattttaatcatacagtatatttttttaacccaatatatccataatattatcatttcaaaatgtaatcaacataagaaaaatactgagatattttacattctctttttagtactgagcctttgaagtccagtatgtattttacaactgcagcacggccacatcctgagtgctccacagcctcctgtggttagtggctgccatactggacagcacaggtctagaatcgtctgatcctggaatcttcccatggctctttctctccttggaagagcaattccatgatcatccacctccaatcttctcaccttcgccacaaagacacgccagcactggtgctgctgtctccatctgtacgtggcacaaaaactcacctgctcatgttctggttgccacctctcttccctccccagtgctgactctgtgtgagctctcagcactcagaagcacgcctggcgcgagcagacacttgggaagtgtctgcagaatgaagacatgcatcatattccacctgacttgcaaagccttaacacaacttctgcaaccttttccctcataactaagggattttcttcctgctgatcctccaccctagccccttcctcaggccttaggaatttgacttttgcctggggacttcggcctgcaaactcacttgagaaactgtgacttgtaaacaacccacacccattcttttcacaagagtagtgcacctgcaatgtcaaactgccaagccactgacatggcgtaaggcatgaggatactttacccaggaagttgcaggttcagtagcactgcctagcacctgcctgtaagacaccccaactgatgggccacaaggggggttgcaggcggcatgcctcagtgaaggctgtggggctgtcatcagggcaagcaggaagccatttcgacattgacaacaggtacaattacactgccatgctgctaagtgacctgtttctaggcttcctagattctgtaagatttaaatgataaacatataatgtttaaaaatgcagtcacaatctctacctggccccaaaaagaggcccccagcccctccattccaccttagagtactgtgcagacacccccggttcccagaaaggcctgagaggaagaaaccgggctgcctccctgcatgaaggaaagccagggagaagcagcccacattcaaccagggacgctccgctgtgaggaccaagtcagggagctaagaccaaatgaacgaattcgcttcttgtttccttttttaaaatcaaagagtatgacaagaacaggcattttagaacataaattactaacagataaaataatgctcaatctcacaaaaatcttctttaaaaacccaaaatgaatgcccatttttagtctatcacttggcagcgatggaaagcaagcagactcggtgctggcgggagaagcagaaacaggcgcttcctcaggccacagagggtgtgcagtgggcactttctctccaggaggctgatttctgaggtgtgaaatgcacacacttccccagccagcaggccctgaagcccagcccacccagaactaacagcacggccgcaggagcaaggaagacaaggacagcctggttctaccaaggacagacgcagcagtggaaccatctccacgggctgcctgccagctctgtgaaccccagtgcgccagaaacacgctcatctgaagacactgccatctgtcaaaaaactgtcatcacatactaatttaacaggaaaagcacactttactgccgtctgctggaagactgtggtgataaagtcccaagcttgtgtgggtgctctgtgtggccaatggggaggtggctaaggaggtgctctccccgcaccctgggaccctctctagtcacccccgaaatacaacctgaggcagcttcccaacacctcacttcaatttcaagacagcagaggaaagacagttctgccccttcaagtcttgaaaatcactcagaacaaagaagacaaatgccaagtacagatccaagtgacgcctggatcggggcttggctcccaaaatgcctggaacccaacgctaccctgtgggcagcagtgagggtacccacagcacccgcagcatgagtggggcaggtgctgacctcccccactgcccgctcaactctgggatccagacccactgcttgagaggtatcccaggaaggagcacatcatgacaggtgtccactgtctggccttgccggtccttccccacaggtacctgtggccacccaccgggtaagaacagccaggcactcttgaggatgaatggacacagctctaagtagacactgaaacccgaagaccccaaacactctcagggctcctccacttgcagggttcgtggggtcaggggtcaggggtcagggcataagtgaagtctgggccaggtctcttgcggccatgttatgggagggtgggaacgttagcaaaggcttagagcaaggctgtgagagaacattgctgtccagcctgcagcagtgtgggcgctgtctgggcctctcttctaatcagtgtggaggatgcatttgccccatcaacatgccagacctgaggccttattaatctgctccagcaacaactgcaccttgacatgcacagcagctgcggccaggactgccagtgccgtaagcctgtggccgtctggggtcattctccagaatccatgcagcttcttcaagggctggactaacgagttagactgggatgcaagataccactgtctctgctcccctgaggcttccatggtggccctagtctcctccacccaccccgggccctgcagggtgtgatcttgtttttgatttactatcttgggggcagtttcaggtttccatttggccttcccactgtgacgactcttactcacaggccaaggaactcgtgtgggcgttactccacctgccaagcgcctccgctccggctacacactgaggactggggagacggccactgggtggcctgggaccctgtggcccactgagagccaccagacacagacggctcaggaatgaaggcctgggacacaggccaggcaagccacagaggcctgccaatgtgagagctgagggtatgaataacaggaaagggtagggaaagagccagcagagagaccacagtgacagggactacagggtgtcccactaacctctgtcttccagatttcccctgaggaagagagaaccatgggcgccacaggaaagccattcccaacttatgtggagaagtagagctgagggggccagggtggactgtggggtccacggaaatgcactccttggtctcccgccacaggagtgagagtgacagatggcccagtgtggtgtctgcacctaccctctgtccctgccagggcacacctcccacagagccgtcagccaggggccgaccgggcagggatgctgaggcaggcccgttcctgtgtgacaccggaggccctcagagctgcaccgcagtctggaccaggcctctgaggggccaggactgcactacgttcagctagcatttgctgcctcctctggctgctcccccttccttctcgcacaggcctcctcccggccagtccctcgcctgtctaacccaccgtggcatgcggaagccgcccacgaaaagccccacgctacagggacaggaagctgcagggccgcccaaatgccctagctgagcgaaggaaatgccaacctctataaatggccacgacacccaggaaaggctcagcaagtgaaatgcaggtgctatggaggcagaagaggcaagggtagcacttggagaagttttcattttattgaaagtccaagtacgtagtagatgtcccagatccccatctccatcccagaagtgaggctccactccttcctcactcctgctggcccttcacgcagagaaactgatgcccagcttccaggtgcagggccacaggcgccgcatgcacagtcctgtgggtaccaacagggaaggcacggtgaggcctgcctgcaacagggctgcctggtgagtttgcgctctgccacatgagaagcacagccctgtaccccagcagccaggcttacatccctccaccaagggactgaaggggccttttccagagaaattaaatggtgcccagagaaaaaacctacagaaggtgacacctgtggctgcctgtggtccaagagacacccattctttaacaatttacccattcactcagtacttccagtcagcctttaatgcttcaatctcttttttttttttttttttttgagacgaagtctcgatcttgttgctcaggctggagtgcaatggcactatctcagctcactgcaacctccgcttcctgggttcaagaaattctcctgcctcagtctcctgactagctgggattataggcacctgccaccacgcccagctaatttttatatttttagtagagacagagtttcaccatgttgaccaggctggtgtcgaactcttgacctcaggtgatctgcccgcctcagtctcccaaagtgctgggattactggcatgagccaccgtgcttggcctaatgtttcaatcttaaacatgatccaaccagacatttggggaaagccttgcgtgtgacagggagggacctaacacactaaaaagggaactctcagtagagaaagacaatgcagggagtgataaaacccttcaacaaaagcttatcctcagagatgatagtatatacatgcaacaagaacagaatgctgtaaaaaggaacttttaagagcaaatgagtgtcaattaactcgtgcttcagagaaaaagaataaagaatggagttaagaggacattctgaaagaaatgatataaatttctcagacctctataatatgtgcttccagactgaaggccaagtgcccagcaaaactaaagaaaaaatgcccacatcaaggcatacatcaaaacatctcagaatacaaggaataaataactgagtttaaaagtttccagagataaaaccaaaccaaaacccaaaaccacagcacttaaaaaaggttagtcatcagccaggcacagtggctcatgcctgtaatccagcactttgggaggccgaggcgggcggatcacgaggtcaggagatcgagaccatcctgggtaacaaggtgaaaccctgtctctactaaaaatacaaaaaattagctgggcgtggtggcggacgcctgcagtcctagccactagggaggctgaggcaggagaatggcgtgaacccgagaggcagagtttgcactgagccaagaccatgccactgcactccagcctgggcgacagagcgagactccatctaaaaaaacatcagatggcactaagaaactccggagccatgctagatgccttgctaccacaggcactgcctccgccattctgagcgcaactgatctgtaactaagaattctacacacatctacacacaaccacactactcatcatgtgagagggcagaataaagagtttcagacatttgaggcctcaaaaaatttctctcccctgtggcaatttaggaagcttttggaggatgcgtcccaccaaaacaagggggtaatctgagagacaaggacagcaagcaaggaatccaacatgggaggcagatgaaggaaacccccacaaaatcaccaagggagatccaggacagccccttcgagcaggtgcagtggcagccagtgcaaaggggaacagggctgaggcttgggagaggttcctgagaagatgaaactgatgaaatacccaagacatctacatgtgctgagagaaaattcagatgcctgatggaagagttagggttgaattaccaccaagaacacagaaactaccccccaaaacaaacaaaaacctcacacaaatagagtataagtgtttgttaactccagggaacaaaaggtgaaaggggaaggtctgctgtgcaaagcatttacacgctcacgatgacgcaacgagccaaacaccatcacatccaccagcctgggaggagggcgaggaaggccgagggtgagggctgggttggtaagaagctaaatcagcatcttatgccccaaactgagaaaggatcaatgaagaaagagctaagcatattatttcaatatggaaatagagaccaaaataatcagctaaatgaactgaaggagtttgcttctagggagagagaaataaagggagaggtggaggtatctgtttttcataaatatttatagaaatatttgatccttgatttaaaaaaacaaaccaagctacctgtttaggaagttgctacgcagttatatgcaaggtgatcctgtctttgaaggatgtaagttcaaaaggacataagtacagatatgctggtgttaacatcagtcaacagagaggtgccatgcagagtgaggcaggacatgcaccagcgtgctctcactggccatctccaggtgctaacagagggctgggttacttgcatttcattttttgaattatataaagtatatacttcggtgggatatcatgggcaaaactttatctttcaaatacttaaaatttatgttttgtattaaaccattttaataggcaaaattaaaagtgtgtctatctctgtgcatggtactgtagatggaacaaaggatggtgcagtccacacagaacagttaacttagggctcctcccttcctgggatgtgggcaggggtggggcaggggggcagggggcaagagggagtttccccctttgctttatacacctgtgcaatgtttggaacttccccacagtgagcatgcatcactctcccacatggacacagatgtggggagagcctggcaaggccatggatgtgggaagcagcagggaacaaggtgacagggaggagaggacacagcaagatgccaggtgggtggggatggtgagcaggaggcagggatggcaacagggccattttctgaaggcttcttaggtttctatacctcgtgctgggcaaaccaaacactcctttgggccccatctgactcaggctgcaggcaccggctattccataaaaaaggcctgccgacgctgcagctctcacaaagcccccagtgacaggaggccattgtttcccacttaccttggggcccaagggggaacaagtcagacaaaccatttccccttataaaatgaataaggcctaatgtagtaagactaataatctgggaaattattctaaagcataaataaaatgtatttaagagatatcaagagtaccttaaattatatgaaggtctgtggaaacttcaggaacagaaatagaatggtacatcaggagatctttaattcagaagcctagtgttactatttttaaagcaaagtcaccaatatattattttaactgaccatctgatggcagcaaaggttctattttaaaaaacagtacactagatggcagatgggaggctgtcagctagccctgggaggacaagagctatccctgacgctgcccttgggccacagacctgaggcttgagacgagacaaccctgccctctgtgggtcggtgggctctacccccaagggaggccttcaatggctgtgatggaaccaatctttcctggcaaaagagatctgaaaaaattattaccactccaccatctaaaacccatctgcttatttctgtagtaacaggctctgctgttcttgtctctcactagcttcttccccacagatttcagttcagcaaaaagatgacctcttgctgttggaacataaaatctaatggcaatctgttgataaaattagtatagtaataatccagggaatgctaagaatatctatttccgataaaattatattatctctgcctctagtctcactcagtattttaattgttttttagaaaaaattcgggccaggaggccctaggtggctctgccacagactgtcaccctgtgaccttggagatccctaagcaggatgccatagaatcctggaagccaggaaatggaaacaaatgggaagaccagaacagtgaaagtcatttcaataattctggaaaaaatttatgaagtcctatgggagaaagactctgtgaatgtaaagaaggtagtcattgtggagaaatattcggccagattccaaatctgaacctgaagaagaaaatttctgctgatgtaaattcatgtgaatgcagagtgtgtggacaagtcttcacatgtccttcatcccttaataggcacatcttatctcattctggacacaaactacatgcatgggagaaacgtggggtgaagccatacaaatgtaaacaatgtgagaaaaccttcatttctctcacaaatgtccaaagacacatggtaacacacactggtaacaggcctcataaatgtaagaaatgtgggaagacatttaagtttctctatttacttcaaagacacaaagtaatttacaacggagaaaaaccctgtgaatggaagaaaggtggtaaagccttgagattttgcagttattttcaaaaacataaaagaactcacagtggggaaaaaccttataaatgtcagaaatgtgagaaagcctttggacattctggttaccttcataaccataaaggtgctcatgctgaagagaaaccccgtgaatgtaggaaatgtgggaaacgattcagtttttgtagttactttcaaagacataaagagctcacaatgtgaaaaatcttccatgtgtttaagaaatatggtaaaagactcactctttccagttccattcagaaacataaaagaaataatactggagagaaaccctataaatgtaagaaatgtagcaaagccttcagtcatccccgctccatgtgaagacatcaaagaacacatattggagagaaatcctataactgtaaaaaatgtggcaaagccttcagtcaacacagttcccttagaagacatgaaagaactcatactggagagaaacccaatgaatgtcaaaaatgggataaaggcttcagtcggttcagttacctccaaacacatgagagaactcatactggagagaaaccttatgaatataaaaaatgtggctgggcgcagtggctcacacctgtaatcccagcactttgggaggctgaggcaggcagatcatgaggtcagcagttcgagaccagcctggccaacatggtgaaatcctgtctctactaaaaaaaaaaaaaaaaaaaaaaatagccaaatttggtggcaggtgcctgtaatcccagctacttgggaggctgagacaggagaactgcttgaacctgggaggtggaggttgcagtgagccaagatcacaccactgcactccagcctgggcaacagagcaagactctgtttcaaaaaaaaaaaaaaaatgtggtaacaccttcaggcattccagctccctttgaacacatgaaaaatctcataccagagagaaaccctttgactgtaaggaatgtggtcaagtctttagacatttcagttctctaagtaaacatgaaagaactcacactggagaggcaccctttgactgtaaggaatgtggtcaagtctttagacattccagttctctatgtaaacatgaaagaactcacactggagaggaaccctttgactgtaaggaatgtggtcaagtcttcagacattccagttctctacgtaaacatgaaagaactcacactggagagaaaccctttgaccgtaagggatgtggtcaagtcttcagacattccaattctctatgtaaacatgaaaaatctcacactggagagaaaccctttgactgtaaggaatgtggtcaagtcttcagacattccagttctctatgtaaacacggaagaactcacactggagagaaaccctttgactgtaagggatgtggtcaagtcttcagacattccagttctctatgtaaacatgaaaaatttcacactggagagaaaccctttgactgtaaggaatgtggtcaagtctccagacattccagttctctaggtaaacatgaaaaatctcatactggagagaaaccctttgactataaggaatgtggtcaagtcttcagacttgcaatgtggtgaagtcttcagatattccagttctctatgtaaacatgaaagaactcaaactggagagaaaccctatgactgtaaggcatgtggcaaagcctttagatattccagtcctgtatgtaaacatgaaaaaactcatactctgtagaaatcctgagaatgtaaggatttggggaaaacattcagttaattcagttatctttgaaaacatgaaagaaattatactggaggaaaaccgtataatttacataacatgcatatgaggaatgtgatgatgcctttatatgttccagttacctctgagcacattaaaaagcacatggaactcttccatttccctttgaaaatacgaaacaaaactactactgaggaaaaattctatgcatgtaaacaatgtggtagtgtcttcagtctttccagttctacttgaagacataaaagaactcatttctaaaaaaccctataaatgtaaagaacgtggggatgcctttgtttctctccggcacattgaaagacatgatgtatgcaaactggagatggatctttaaatacaagaaggtattctgtatctaaaccctagtagtttgcaaataaattttcattttaataattatttcaaaagtcatctgagaactcccactgagaacaaatcttataaatttaaggaatttggaaagcctgatgcaaattaaatattccacaatgctcaaaacatgcacatgaatgaaatgttatacaagttataaatatattgtgtttgtcagtggctcatttctaatgaccatctctggactgttgatttccaccttatttaacacgaaaatattgaggtgagaattctgtagataccctttaagcaacatgaatccaataggtagtgtgggtttttttgtcagttaatacaaaattttgtctgtatgtctaaatgtttttggatctacaggtgaattaaaatgtatttctaataagtaggtaacactgatttttatgtagctttttaattgttctgtaatatgtcattgaaaacagattttgttaactgttggggttttcttactggccttatttgacaagttttaattgttcttcacctattacatcaattccatctttcttttttatgaaaaatgtactgttttttggcaggaagaagtttatttcattttctttgctactgaagtattggtatcaaattgtgaaaaaaaaaaatctatcatgatagtctgcttacacagccgtacaagtaataataacaaaaaattgtaaaatcagcttagagagaattatattaattatattatcgctccctagcttattaaatgtttttcctgacagtacagtcacactgttattcaaatcccggcctctgctgagcccacaggcctgctctgaacccttgcggtgcagggtctggccactcccaccagtgatgcagggaagctggcacggcagaattttaggataagagaaatggatatgtgggtcattatttaagaaagagagttctcaagcagctgtctcactgactacttggcctttaagttccttgctcattaaaaatgggatttcacatatggcaaatatattaaaaacaggtgaatgtagataaatggtagttggaagttctctgtcctattcttgaaatttttctctaagttttaagttactttaaaatgaaaagtttaaaacaatgtattcttgcgcagtatctgactgagagcgcagtacctggctgtgtccacagcagctggtctagcctggcaggccaggcggctccacagatgcctcctagaatgactctcttaaaacaccatatgattccatcatctatttggattttcaagcctaacaattttttttaaatgttattttgtatgtaaaggattatgacaaccaaatgattgtttttaaaaataaaattaatacatcaccacttactctatgaattataccagctgaatgcagatgtttaataccacaaagcatctggtaaagaaggtaggacattctttcatgatccagctccatgtgaataacctgacataagttagcatccattaattccataaccaaatacctgagggagaaaaggtcagttatttatttgaaaattatccaaagttcctttatgactaaatttcatgaaactgtaacttacttccaatcactgcactggctaaagtaaaaagataacttggtataatggaactttctaaaaattttccaaagaatatataaataacaaacttaacgtcttacaagttaaaaattaaaaaaaaaaacaacaaccttttatagcatggtaaatagaatctcaaacacaaattttcctacttcttacatttttggctgaaattctccgtaccagcctaaagaccatgctgttacaggctcatcaatcacaacacatgtaccctctggtgggagatgctgagaacgggggaggctctgcacgtaaggggctggagacagacaggaactcagtacctcccgctcaattttgctgtggctctaaattgctctacaatatatacgtttttaaaagtgattatacaacaacaacaaaaaggacacttgaccccactccccgcttagcaacgccccgattctttgctccctttgcaagcaaaactccccaaagaggtgtctcatgtgctatctccaattcttctcccttctttttattttttaaatttttttgagacagggtctcactctgtcacccagactggagtgcagtggcgtgatctcgcctcactgcaacctccacctcccgggttcaagccattctcatgcctcggactcccagaactgaaaattaaattaaaaaaaaaaaacagccatcatgcctggatagtttttgtatttttagtagagacggggttttgccatgttgcccaggctggtctcgaactcctgacctcaagtgatccgcccacctcgggccttccaaagtgttgggattacaggcatgagccactgcactcagccttctcccatttttttcttaatcccacttggatcaggtttgtgcagccaccattctgctgaaactgtcctcctcgaggccactgatgtcttccatgctgctaaatccactggccagtcctataatcccagcgggccctgccctgtcctgtctctaacttctcgctgtcaaaatacccagcaactggtccttgaccctcttctcttctgtaaccacactcactttcttagtgatctcagttacaggccatcagctcccaaattcctacgttcaattcagacatatctcctgaactccaggctcattcctctgcctccctattcccagttccaccttgatgtctaacaggcatcttaaagccatctccagaactgaactcctgattccatccctagcccagtctgctcttctcacagccttcatcatctcagttgagagctccctcatccttcaggtgctcaggccaaaaatctaggtgtcattctcaattcctctctctcataccacacatctcatctatcagctaataccatggctctatctttagaaccatttcagcatccagtctcttcccctctcacccttcctattacccctctgggccaaatggaccctccgtcatcccttaacagaactgctgcaacagcagtaactgatgttccatgcccccaccccttatagtgggttaccaacccagatgccagagttacgcttttcaaacagaaggcaggtgagctcactgctctgctaagactcttactctgacttgccttagagcaaaagacatccttacaacggcctagaggcttgtggtgttcaccctcttctcttcccctgctccctcatctctagccacgccacctcttgatggtcttggaaaacaccaggcgggcatccactgctgtcctgagcgctgtctgttccttctatctccattctacttgcccccaaagtatctgcggcaccaaattctttttttttttttttttgagacagagtcttgctctgtcgccctggctggagtgcagtggtgcgatcttggctcactgcaagctccacctcccgggttcacaccattctcctgcctcagcctcctgagtagctgggactacaggcccccgccaccacgcccggctgattttttgtatttttagtagagacggggtttcaccgtgttagccaggatggtctcgatctcctgacctcgtgatccgcccgcctcggcctcccaaagtgctgggattataggcgtgagccaccgcacccggccagaccaacttctttatccccttcaaggctttcttcgaatgtcaccaactcatggaggtctttccccagccaccttatttaaaactgcagcctcaagtccaaccctcagcacttttgatcccctgacccagctccaccctttgtccacagcacctagcacattctaatggactacatgctttcctcatttatcatgtggcttgtctatcttccctgacaggctccagggaagccaggtaggccaagtcccagagagtgcccagcacacagagggcaatcagatatttgttaatgactgaacacaccaataaattcaggatgaagttgggcattatgcctctcaatagattaatacttcatttcactgttagtaagatgattctacttaagattctggaaatacagaatcttaaatagaattagtgacttaatcattttaagtaatactcataaactcctgaaccctaaaatcctggctatcagggatttgagaaaaacattttatagttcagcaaaacacattagtgatcctggtctgctctgaagaattctttccagtcatcctttatctgttatgaagatgaaaacccatgtggtacaaataattaaatataactatcaaattttctaaatatttctctgcaacagagaaagttatctgtgatgtcacaaaatgtattgccacctacatttcctaagtataaaaagcagttgctgtcttttctagatgttcattctttgatgtacagtgcattactgaataaaaatgatacttacacatcttgaaattcttctagagttttttgtggtgtaaacacatttaacaaactaattatctgaaaagagaaaattaattatacttcaatatgtcagattacttgattacaaaaattaagtttaatattgaaatgcattaagacgggaaaaaaatcacagcagaattcagtacttcttattattactgcttttaccaattacatggcatttgagaaaagttaaacatcaattaaaggaaagatgcacttttaatcaaatcacttttatgtgtccctagtaacttaattattacagaatttaaacacataatgtctttttgaacataaaaaagtagaatttacaggtaaaaagacattaaagcagtatgttaactctgaaaacttaaatactacgcacaaatttctaaaaaggtttgaaatatgaaggctaagctcttgtttttggtgtgataaagtgaaaggcctcgtagcatcatatttttacctaaagagggttaaagagctgatcctgcggcaggcctccatcctggcaccctgacatgatttggctgtgtccccacccaaatctcatcttgaattgtaatccccataatccccacgtgtctagggagagacctggtgggaggtgactggatcatgggggcggtttcccccgtgctgttcttgtgacagtgagtgagttctcaggagacctgatggttttctaaggagcactgcccactttgctctttacttttctctctcctgccgccttgtgaagaaggtgcctgcctccctttcgtcttccgccatgattgcaagtttcctgaggtctcccacatcatgcgcaactatgagttatttaaaccgctttcctttataagttacactgtcttgggtatctctttatggcagtgcgggaacgaaccagtacacagcccatggtgtaaacagcgagtcccacggcttaggcaccaaacacataacctcagtcattccagatgactgagggaaagatgaattatccattatacaggattggggtgattggttagctaaggacaaaaataaaactgcatccatatttcaatctttataccaagaaaaactctaaatggaacaaagacttaaatctaaaacatgaaataaaacctcagaatatagataaacatttatataatcctagcgtagaaaatcttttctaaacatgacaggaaacctaagagatctgattacattaaaatgaaacaaaaaatgggtgataaaaaatcagtatgtcaacaacataaataatgtcaaatggaaaaaaaaaagtaaagggcaatagttttaatatttaaaaaaaaaaccctcctacaaatgcagaagagaccagcagtccaaaagaaaaatggataaaggccataaaaattaaattaccaaaacacataaaaataagtaacaacctcaccaataaaaataaaatatcatttatttatcaaattggcaaaagcaaaacaaaaaaaatcaacagtatgtagtgctgggggattctgaagtaacagacgttctcagacactttttttttttttttgagatggagtttcattcttgtcccccaggctggagtgcaatggcgcaatcttggcttactgcaacctatgcttcctgggttcaagtgattctcctgcctcagcctcccaatgagctgggattacaggcgcccaccactacgcccagctaatttttgtatttttagtagagacggggtttcaccacgctggccaaccaacgtggtcttaaactcatgactcaggtgatccacctgccttggcctcccaaagtgttgggattacaggtgtgagccacagcgcccggctgatacttttttttttttaggagatggggtcttgttttgttgcccaggtgtgccttaaactcctggcttcaagcgaccctcctgcctcagcccaagtagctgggattacaggtgaagtgaccgtgcccagcttctcaaatactcttaatgaaaatatcaaactaatagtcttccttgaggtcaatttgtcagtatattttaaactagaagtgtgtgtactctgacctgacaatgttggccaagaaattcacctggacgagtatgcaaaaattcaggcgttagaatgttcattgcagcactgcttataacagtgagaaacaaaacaatctatccaacaacaggcggctggcagtctcttaaataaattactgtgcatctgtgctatgcaaccatttaaaaactggctcatatctatgttcattaaagtatatgaggtctaccaacattgcacgaggagaaaagcaggatgaagaataacacgattaatcttgtttatgtacttgtgcacatgtatgcataagaatgctcaccaaactgttaatgctagtaatctgtgggtggcggtattcaggagtttttacttttttatattgtttgaatttttaaaaataatatatattttttgtaacctgaaaaaattttttaaataagtaagtaaaacaagtccgggtgcggtggctcacgcctgtaatcccagcactttgggacgccgaggcaggcagatcacgaggtcaggagatcgagaccatcctggctaacatggtgaaacccctgtctctactaaaaatacaaaaaattagctgggtgtggtggcgggcacctgtagtcccggctactcgggaggctgaggcaggagaatggcgtgaacctgggaggcggagcttgcagtgagctgagatcgcgccactgccctccaggttgggcgacagagcgagactccgtctcaaaaaaaaaaaaaaaaaaaagaaaaagtaaaataaagcatgcattagagaaatttaaaccaactcaagccacagactcaaaagaaggaagctcaggagtttaagatcagcctagacaaggtggtaagaccccacctctacaaacaattttaaaaactgccaagcatggtggcgcacgcctatggtcccagctacttggagggctgaggtgggagaatcacaacctgggtgacagaatgagaccctgtctcaaaaaaacaaaacaaaaaaaaccagatttcacgttttatattttatttatttatttatttatttattttgagacggagtctcgctctgtcgcccaggctggagtgcagtggtgctatctcagctcactgcaagctctgcctcccgggttcatgccattctcccacctcaccctccttaattttttgtactttttagtagagatggggtttcaccatgttagccaggatggtctctatctcctgacgtcatgatccacccgcctcggcctcctaaagtgctgggattacaggcgtgagccactgcacccggccaacattttgtaattttataacatggcaacgttatcaacataatgctcagcgaccactaggagaacaaacaatgtgcttgattgaacccaacttcattttctagaaacattatttctccgtaaaatttagtgctttgatttctgtggagcttccaagaatagctactctaaatgtaacatcatctaataacgtgtatttgaaactggtgtgtcatatacaaggtaaaaacctacttatagaacaacatctttccacaaaatatttagttgtttctcaatttgttagatcaatactgttcctattttatagaaacagagtatcaattgatattcctactttggttaagtgacctaaattcctatgcaccataatgatgcctctttctagctttgatttcctcaatgtttattaagaattttatcagccgggcgccatggctcacgcctgtaatcccagcactttgggaggctgaggctggcggaccatgaggtcaggagatcgagaccatcccggctaacgcggtgaaaccctgtctctcctaaaaatacaaaaaattagccgggcgtggtggcgggcgcctgtagtcccagctactcaggaggctgaggcaggaaaatggcatgaacccgggaggtggagcttgcagcgagccaagatcccaccactgcactccagcctgggcgacagagcgagactccgtctccaaaaaaaaagaatgttatcaataaaaaataggccgggcatggtggctcacgcctgtaatcccagcactttggaaggccaaggcaggtggatcatggggccaggagatcaagaccatcctgactaacatggtgaaaccccatctctactaaaaatacaaaaaattagccgggcgtggtggcaggcgcctgtagtcccagctacttgggaggctgaggtaagagaatggcatgaacccgggaggtggagcttgcagagagccgagactgcgccactgcattccagcctgggcgacaaaaaaacaaaaaaacaaaaaacaaaaaaccaatgttaatagccatttttatccttagcttatcctaggtctgaactcaatgtatctccagaaaaccctgaagattaccacattattgacaatatggaagcacacagacaaaatacatacataacttacatttttatgattgacacattttaagaggacaagttcacgataagctctctttgcatgagtttggttctgaaaaggacggcttagtttcttgactgcaacatttatcccaagaactgtatcaaatgcagcactagaattaggaaatataatgcacaatccattagaacggttttggaaaatacagcaatgccagaatatacattgaatatatcatctttttaataagtaacaaggaaaaatctgcttatttcattcaaggtacttgcacatatgaagagcagagtgagttgtctaagactacagcatgtactaactcctttgcagaggcacatttcagccacagttaagatggggttcagcaatccttcacacaccaaggtttcatagtttagattacattcaaaaccaggtaatttaatatagagtgcataaaaccagtcaagaaatgaaatcttcagtttaaacatgacaagaagttggaaacaaagtcactgtttcctgtcttaaaatgtgtatattttggaatatcacagtagaggaaatggctgaattcatgaggagaataaatctaaattttgaatcactgtgtttttttcacaaataacagtatctaaaaagaaaagaagccaaaatttcagctcatggtaaatgttcaagatacaaaatctctaacgtaagcaactgctatataaagttcttttagaactatctcctcctactactatagtaagaataaaatctacaggctgtgtttccagcatctcgtttcctgttgaaattctgttcattttcctccagaaaatagacatgaagaatcaagtagcctgattacacatttttaggtttcaaactggtactaaatagtatcatttgtattatcacctctgggctactcatgagggctaacagctactaaaggccacctgagaacctaagcactgatttaaatactgtttctatttctttattccattgagtttataacattgtttacatttattctcttctattaatgcttttgccaaactcgaacctaattcaatctgttttaaagttgaaggctatctgttgtagcatttggttaagaagctaccttactttaattcagttcatattatgtgtctgtctatatacatatgtaaatccacaggttcatatgcaaattgcaccatttatatgaattataaaatgagaaggatatatccacttgtgaaacaagtcattgacatacatgtagccatgtatgtatttatacctatatacttctcagactcaagaatttgaaaataggccaggtgtggtggcttatgcctgtattcccagcactttgggaggccaaggcaggcagatcgcttgagcccaggagtttgagaccagcctgggcaatacagtgaaaccttgtctgtacaaaaaatacaaagattagctgagtgtggtggtgcatgtctgtagacccagttactcaggggactgaggtgggaggactgcttgagccgggggtcgagactgcagtgagcactgatccctccactgcaccccagcctgggtgacagactgagaccctgttgcccagggtctcaaaaaaaaaaaaaaagaaaaagaaaaagaaaaaaagaatttgaaaacagacacacttttttggtatcaaaagtttttgtccaaaatttcagttagataggaggaataaggtcaggaggtctactgtgagatatggtgactgcagttaataacaatgtattgtattcttgaaaattgatgagagtagatttgttctcatcagaaacttttaaaaagtatgtgaggtaatgcatatgttaattcgctcaatttagctagtccataatgtatacatatttcagaacaatatgctggacatgataaatatatacaatttttatttgtcattttaaaaaagtttttggctaaaacaaggcaaatggaccaagtctaagcatctaagtgggcataagcttccccacttgtagctcagctccatgaggaactaccttcagttattcctggttgtggttattgcggtcactcaaagaatacattgttatcactatctcttcatttatcagctttagaaatgattcacctactccccattacgaaaactgagtatttggccacttccttgaaatccccaatcgccaacacctcctattttttttgttgttctgctttttgggttttccctggttacgtctttaagtaacacccctaatcttcacgcttcttcaactctgaagggaacgtcttgacttctgcttacgtaaaatgagactgttccatccctttctcctccatttaccatatattcataactaagtcttctgtatttcttctttaggatgtttctagaagttgaaaatcaatacatggagtgtaggtgtgtatgtgtacaatgtaaatatcactaacggccagagttgggattacatttcattttctaaagatcacatggctcttgctgccactcataagagggtgagactatttccaggatcaaggacaaaggattctcttatatttcatcaactgctcaaacatcatgtcctctttgtttcataattagaccatgattttttctagttttccccacacatttctaataaataatagattttattacattctagattattattagtttttactaataaaaaatgccagttttagcctatcattgacacatcttagcttctcacattatctgttgtgtggcacctactccacatgatttgcagacactctttagcctatcactggcacttcctagcttcttacattattgttgtctggcatctcctccacatgatttgcagacactcttcttgcagcttccttaagacctgccatgcagccaccatcctgggatttcttttcacagtccccactgcttcttgcattacgctcttgtgttgcctctcttgctggagtacatcctcaaggaatttcctcagaaaaggtgcatggaagatagatggtattgctctgcccccacccttgattgataataagttttctgagtttaaaatcaattttctgtgagaactttgaaggcacttttccactgatttccacactgagtgctgacagtgaggaggcttatgcccgatactgtactgattcctttgcttctttttttgtttcccagctcaatgatttatcagtcatgttctctctgtatcccaaaagcttctcacacccccaactaattagtgtccctcctgtccaccagtgataactgctttgacatgtacaataatcactttcttgctttaccagctaaagcatgcaccctggagctcccagtttatttttgcctgttttttgaaatcttctgtgtctgacttctgtggctcaatattatgggactcatccattgttgctgtatgtagctataactccttccatcattgctataagattcctttgtataactatatcacattacgttgatagatatttcagttgtttttagttttcaatctattacagaacacacagtcatcaccattcctgtacgcagctccggatcccctatgcatgtgtttctgatgagtagacaactaagagtgggaacgtatccattgtatttcagtagataatgtcaaactctttgccagagcgtttctacaaatttgtacagctgccagcagtgcacgaggggtcacatctgagagctgcctctgcgtggttccagtacacgaggggtcacatctgagagctgcctctgggtggttccacatcctcaccagcacttggtatcaccaacagcttagtttctaaccattctgctgagtgtggaatggtatttcgtcgcagttttaaattgcactatcttgatgaataacggcattgagcacttttcctgtttataggttatttgggtatcctcctgtgacaacctattgactatttgtttgtctatctttataatcttcttgactgttgttctttacatattctgaacaagagattttttttcagtcatatatcttctcacatctatgcttatcttttcagtttcttgatcttggttttttaaaataaacaacatttcttaattttaatacaaaattgatcaatcttctatgataatttttttttttcttaaagtggagatggggggagtctcattatgttggccaggctggtcttgaactcctggcctcaagcgatcctcccaccttggcctcccaaagtgctggaattataggcatgagccaccacatccagcagataaatgtttttttatgttgtgtttaaaggagtccttccctaccccaaagatcatgaagacattctcctatattatgttcaaatagctttactggcttgccttatatatttacagcaattcaactgacattcacttttgtgtataatatgaggttggggtcaaatttcacttttttctacatgaacattcctatgtccatttatttaaaaggctagcctttcctcattgctccacaggccaccactgccataagtcagaagcccacacatgcatgactctgtttcagggctagtccactgtttctccttgcaccacacgacaccagcttgatcaccagttttatggtaagtcttcacatctcgcagagggagtgttcctcccttcttaatgggtgtcttgaccattctagggtttttatttttacatataaattttaaaatcagtttgttcatttctttgttttttaagacgactgagatttgattgcaatcactctagacaagtctgaaaaatgaccttcatggtattaaatattctaactctgaaaatcagacatcccaccacgatttcagttttctctattttttctaatttttttagctttttgtatacaagtctttcatattgttagatttttcctccagatatgataatttaaaagtttttatcctattttaagtggtatccttttcaaattttcattttctatatgctgctagtatataaatatgcaattttgcagggggaggggtacatatactgaccctgcatcttgcaaaagggctaaacgtactcattaatttaacaaaacgcagattatccaggtgggcctattcttatcacgagagccctttaaaggcagagtttgctctggctcatggaaagggtggaaaatcagggagatgtgagtatgggaaggactgggcatgccactgctgccttgaagatggaggaggtcacttgagaaggaaaacatgcagcctctgggagcagacagcagcgcctgactgaaagagatcaagagattgggaaccacagacctaaagctgtaaggaactagactctgccaacaggctgaaggagcttggaagcagatacccttccagaacctccatctgtgagctgagcccagcccagtcgaaatcttgacttcagctttgtgagatgctgggcaaagaacccaggcaaacccacccaggtttctgactatagaactatgagataatcaataggtgttgttttaaacaactaagtttgtgttaatgtgttatgcagcaatagaaaactaacaccttctctgttttgggctcttctaccatttttgcctctgcagctttcattctggatactttttgctgacctctcctccaggtcactaaatctctcttcagttatatctagcatgctgttacacatattaaattcataattcaattactatagtttttacttctagaattttgatttattcctcttaaaagaagttttcatttctccaccaaaacttttaatcttgcctttatcaccttgaacgtaatatcatagctatttaaaaatgtggatctaataatgccaatatctcctatggatctgtttcttttgtctgctgtttctgcaggattttattcatgttgtcatatctccttgtgtgcctagactgggccttgcacgtataaaactgtttgctatctagaaataattttatctaatatgatgctgtcttcttccacaaagaatttaaatttatttctactaggtacctgggggcactagcaatttttgtttacccccatacaagttcagcaaatgagatgataatctgaagctgagtggcagtgcctataagggccaatctctgagttacctttacttctaggaagcagccttttattggtcccaacacaagtaaaagaagtttgccacacaatattagagggccctggactctcatccctgtctcctagccacagggcagtccaaaacactctctcaacagccccttccagaattttcaaatgcccccaagggaaagacagccccacatgctgaagctcccctcactaggcttctgtgcttccccagatcctgacctagtaactcctcactaacttactagctctctaggggaaaatgctgagcatgggggacagtgggaatgttggcagaaaactggcacagctgtttcacaggcacacttttaattaacagccctagttttagccactcatttcatctcttcttcattgtcatctctatgcccacagcctctgtagttttactatagctaggttctcttccttacgcacatacttcagctgcttattctcactttatctgctgttttatctgtatcacaagattcaagctactttctatatttcataaatttgttaaaactgtcttccacttattactgccctcttatctttgtacaggtgttcgggccaccatcttaaatgagaagttccaaaccactcattttacaggtgaaaatattgaggcccataaagaaactgatttgccctgctcacaaagaactcttcgctgaggaaaagagctggactcagaactcaagtcttctgaatcacagccatcctgtgcctcaaaccatgtctcctttatcacagaaattttgttgtgaacattgttatgtttttatttatttatattaatagaaaataaaccatgttaagaacaggccagtactcatgtttatacagaacttgaggacacaaaaaggaacacgctataccaattatttcatgttaaggctgtaactgttacttctaagaaccgccagactcaatattgaacacttttttaaaggttaagcatttcatagaatggtttcgtaaagcaaataatctttactattttggccaaacttgagatttttgaaggagaaagaaaaactgaatatatgtatgaaagaaatgtacatacattttctccactagagcttcaaaatcttacaattatttaattgtactataacacagttgatatttatgaatacttcaaaattatattttaaaacttattttaggccaggcgcggtggctcatgcctgcaatcccagcactttgggaggccaaggtgggcagatcacgagatcaagagatggagaccatcctggccaacatggtgaaaccccatctctactaaaatacaaaaaattagctgggcgtggtggcgcacacctgtaatcccagctactcgggaggctgaggcaggagaatcacttgaacccgcgaggcggaggttgcggtgagccaagatcacgccactgcactccacctggtgacagagcaagactccgtctcaaaaataaaataaaatattttaaaatttaaaaacttatttcctaataaattttactaacatatttaaaggaacaaaaacaaataaacaaatcaaagacaactataaaaacaattcaaaattaggaaccagaatattttcttctggctccagctcttccatttaatcctgtacaggtcacaggccctacctgcacgttggtttatctgcacacctgcccttcataaagctctaatttaaatagaagattaactagttgcataaaccatacactgttgctgttatatttctcaaaaatgtagaaatacacatgcttgtgaattagtttcctattgctattgtaacaagtaaccaccaatttactgctttaaagccacacaaacttactatcttacagttctggaggtgagaagtccaaaatgcatcttatgcctcaagaggtaagcagggctgcgtggctccttctgcaggctctggggggagtctgctccctgcctctctcagctggttggaggcttcctgtattgcttggctgtggccccacatcactccaaacttcgctctgccatcacatctctgactatgaccttcctgtctcccttttgtaagaaggacccacccaactaaacctgggataaccctcccatctcaagaccattaatgtaatcacaccggctaaattccttttgccatgtaaagaaatatacaaattccagggattaggacgtggacatctcaggcgggaccattattctgcatgctacactccccaaagaatcactgacagatgattttcaagtacaatagtgatgaaaggaagtttcagatcatcaattaactacataatgccaatattttaatacgaaatatgatagaaaatccaattcctcttgtcagtgttagctaatctactgttgagcttatttttggaaaagcaagcttttttttcttttttgaaacgggaatgtgccgtaactagattatttcccaattctacttggtgcctcatagcctggtgaaggatacagagaaaagagaaaggtgaaaaggaagcgaaaatcacttataaagtgtttactttccctattagaacataagatagaaggataccataaaactgaaagtcagttatagctataaaaattgaaactgttcttgaatgtaacaattgtcttatagagataaatacaattaaatgaaaattgtttaataggtgtttagtgaatatttgttcattattactaagattctaaacagaaggtgggtcagaggccttgacctatcaaagtatcagtggttcaaagtcttcaacaagtctctccgtggtacaggcaataaggtcccaaaggcccacagcttgttttggtcccaggcctaccactaacaccccgtgagacgggagaagcaagtgagccttcctagtccttcgattcaccaccagtgagggttatggcagagctcatggtgattctacaatatacactattcacattactaccaaccttcaaaagcaagtgaatgacatgccagctgggataaatgaagcacgtatttaaaacagctacctgtaggccgggcgcagtggctcatgcctgtaatcccagcactttgggaggccaaggtgggtggatcatgaggtcaagagatcgagaccatcctggccaacatggggaaaccctgtctctactaaaaatacaaaaattagctgggtgtggtggcgtgcgcctgtagtcccagctaccgggaggctgaggcaggagaactgcttgaacccaggaggcggaggctacagtgagctgagatcgcgccactgcactccagcctggtgacaaagtgagactctgtctcaaaaaaataaataaataaataaaacagctacctgtctatagccacaaacaactccccaagacctccgacatttctcccttcttgccccctctctcctttttctctctctctctcgcatgcacacatcaaattatctgtcaaattatcatctaattccaaataggagatgggttataaaccaaaagaatgctttgttgtttataactttccattaccatcaaagtttcctaatttgaaccatcctccactaactttaaaacttttttttttttttttttgagacggagtcttgctccatcgcccaggctggagtgcagtggcgcgatcttggctcactgcaacctccatctcccaggttcaagcgattctcttgcctcagcctcccgagtagctgggactacgggtgtgtgccaccacacctggctaatttctgtatttttagcaaagacggggtttcaccatgttggccaggatggtctcgatctcttgacctcgtgatctgcccagcttggcctcccaaagtgctgggattacaggcgtgagccaccgtgcccggccacctttaacacttcttctggcacactggatttaagtgccgatacagcatgtgtcatcaggaagttaagatcaccattactttagatgcaagctgggcattccttccaaacagtccctttcccgccttagcttctcaaagaagctctggactgcaatttcctcttagctcccagggccttcagccgccagggctgaaaaaaacaactgtttccctgatcataggtctccgcaacaaaggatcagttaaaaatcatcgttaaagattctccaaacccaacatctctacaaggaaatgtaaactaccctactagagcatcgaaaagagctttcttctccctcaaccccctctgcctaccagctgtaaacacgcgatgtttaactgcaccacggtttctttaggcgcaaaggtaatcctgttttcattgaccaaaaaaaaagaaaaagaaaaagaaaaaaaaaagttctgcccagaaaaataaggggtaaaaagtgtgggaagtgctgatagctgcagtctaggaaacatgtgaagagctttaccttgagctggcccgtgatgctgcggcggctgaccgtcttaccatgcaagagactaacgttcagggtcagactaacgattctgacgttctgggctggacacacagttgaagtgagacaccaaggaagagatggccagcccaacccctcacacagcatcccttcctggttaatccatggagtgacaatgacactgactggcctcatcctgccaatgaatggcaaggcactgcaatgatggcgcctggaaatgaacaggagtgatcgggaataaaaggggaggggggaaaaggtggccatgatgaagaaatgaataaaactccaaatttctgttacaactcactgtcatacctactactctgatatcataatgacaggagaaatgaaaaaaaaaatgaaaggaaaaagaaacaaacaaaaaagaaaacttgctacctatttaaattcctgcagcattctaagaatatgggtttgtaccctacagcctgactacacagaactagagcaagcagttgattcaatttagctcataaacctataacagagttttttttttaatcatcaatgtttctaaatcctgacactttagttttactttttattacagcaaaaactcaatccacgctattaaaacagaccatacttaccaaacaatcccttgggccccagagccaattggtttcagctgctggtaacgttttaggacagtgaaggttgagtctgccacttgcacactataaaactgactgtcacatttactgtcgctcatgatgcagcgtcctgcaatatcccgaagggtgggcaagtttcagatcccttcaaagaaaaacagaatgaacgtgcattcttaccggaagtacatacgcagctcacgtaagagagttctgaacttattggtatgtaagacaatgtggctgtaagttgataaagtcaatctgaccaagttctgaacttaagcaagacacaaaaaaatgcagacatttcagtggtaccagaccattatgaaaggaaggaattttgaggcccagcaagaccacactttaaggggctggactagaaaataaccacctttggagaaaagaatgtatgcattactactggctatgaaaagactacatcactctgtgcgtctcatcagcttgccccctgtgggcaagctaggtgtaaatggttcatttacacctagctgtctagagacggaggcattgtttcaaaaatgatcacttctagaatgcctaaagagaagcaaacggaccagtcttctgctcagtgtatagattctggttgaaatgatgaaccaaaaagcaagattcatacgccaaagtgacaggctgtcagaggcctggtggcatcagtgtgctgcatgtgcccaagcacgtgctcctgcctcaggaggtgggtcccagagctggcatcagctggcacagccccagagtcccacatcaccaccggacttcagggtagagatctgtatatgaagaactctgctgtgactgacagtccatcatagtaacactaggaagtctatccactatgtctgagtgtaggccagcaggcccagaaagcagcttttctgtggttgaggcacaggctgagactgctgctctgcaggagcctggatgattttatacagaaaacaagcaaacaaattggcaagtggttcctaggctcgtgtctggttatgcttatttaaaagtcagcaagctatttattttggtcttttaaaactacatagccaacaataaaatcatataggtaaacattctataccgtttaagactacagaatgtattctacagctctgtcaaatcccttgcctttatgttctagtatctaatatttaacgtcaacctaatgagatttttgtggtgatgatttatatttcaacacaaatgctaggattttccttaaacatggaaaaaatggattaataacaagtctaaataaagaactgagtcaaattaataatttctccaagtgaccactgccccacggtcttctccccgtcctctgggtggtggctgcagtgtggctgccactctgaccactcctgccgaggtgtgttagcgtgccagccagggagtgactccagtgacgccacagcgcttagatgctggacaaacagctgctcatacaacccgcaccgcaggagtctcagtcccgtgttacctgggagcaatctagggctgagtgagctggaacacctgcctagcccacactgctgtgagaaggggactcaggagctctccaggctggcaggtcactgtgctctaagctataggaggtgcgaggcaggtctgtcttgctcatggcatctcatactccaaggacaggaggacaggaagctggtctttggggcactgtgagcattcaataaacctttgttgatctgattccccacagtgctgctccattttactgatatctaaaggaagatcctttctaaagattagcttatttacagtttgcaagaggctgaaacaattccactcaacatttagggggtacctttatgcacgaaagtggtaagtatagcaaaagatatgccatagtcagctagcaaccagtcttgaaacaacatgtacttcactatttgggggagaagcgcgagcagtgagtccattatctatattacaagtcacagtgcggtaagggccataagcacaatgtaaacaaaatcaaaaggcaaaagagatcctacccactggcaggggcagaagacaaggacggcttcaaggaggaggcggcatccgccctcagactcttttgccagagatggacagtagagccacagagctcaaactgactgtgtccagacacagcgaactgctgagcttggctagcggggtacaagtgcaaaggattagagacaactcagcaaaaaggcaggcacccactaccacctgctttacggagggtggctgttcctctgctatgccgtcaacacaccagcaacacagttacttgcaagcatgtactgagcacccgctgtggatggtgaggtaccatgccaggacactcgcctgccctcagtgagcgcacactcaggaggaggccctgcacaccaagggtcctaaacccagtagggtgaagaagatttgggggaatgggaggagaagcagcagaggcggaggcacattcggaatgtgacaagtcactagggacttgctgggtagagggcgagtgaagctggagagagaaaaggaggccagatcactatgagccccagaagccacgcagagccgtctggcctcagtcctgagggctgtggaagccgtcaaaacatcagaggtgcgacacaggcgctgaggtgctccaggatccatccctcccttcctcgctttcataagagaagccttccttccccttcctgctagataaatggctgcccaactagagacgacgcctggcagctttcccagcagccaggtatggccagatgaccaagttctgactaataagatgtgggtagaagtgatgtatgcaacttccagatcacttttatttttctttacagaaagctgcttgccctccaatctttcttccttgctgctggctgagggatcagctgtcacagacccagagatggaagtcacatgctgtagatggaaagctgcccaccagctggattccttaactacctcatggcacagagccaccccccattcaggaccccgtgtccacgttgggactgacagatcaatctcaaccctgctgaccaactctgcaactctccctgctataactgctttcaacctatatttggactatgacaatattaggttaacttttttaaatttggggagtatattcactcatattaggttttagaattgtaattccatctcaagatttaaaatagtccgggcatggtggctcacacctgtaatcccagcactttgggaggccaacgtgggggaatcacttgaggtcaggagtttgagaacagcctggccaacatggtgaagccccatctctactaaaaatacaaaaattagccgggtgtggtagtgcgtgcctgtaatcccagctacttgggaggctgatgcaggagaatcatttgaaccgggaggtggagattgcagtgagctgagatcgtgccactccagcctgggccacagcgagactccatctcaaaaacaaacaaacaaaaagatttaaaataattataaaattaaaataaggtacccttattatgcaggagaaaaaagtcacctaagtgaaaacctgttaaagccaccttctctgtcaagtttgggctttgtgagagcaagagaaagaaacttaaggccacctgagaaggtgtgtaatttagctattcatgagtcaactctattgagatgatatttcaacaaaatggaccatcaactggggctcagaaaacagttttacaaatcgggaagtacaagaattcttcatgaaaccacattagcaatacactaaagcctgcattcgctgcctccacttcccacaccagccggtgctggttcctccccctcagctcccaggctgtgctgccaccatccgtccagcacagggctccctccttgccacttgtgcactcagcagcgcccgccaggctgcactgtcacagcctttgtagggtctgcctcccttccaggctatgagcaactcaaaactgggagggaacgctacaaggaggtttcctggaggaggcaagacctgagctcaagtttgttcacagtatcgaccgaggcatgaggaaacaggcactttcatacacgtcagtgagagctgagaagtggtaaaacatttttttagatggaatatagatctggctaataaaaatgttaactgcatatcctaaactggcaaacacaattctctaagtgtatctgacaaatacgtgtacaagtatccaaacatatttgtgcaagcatgtttgtaacacttcttgtaacaggcaaaaaactagaagtaatctaaaatgcacactgtggatggactgaataaattatggcacagaagtacaacaaggccattcaacagaatgcaaggactttatgtatcaatgtggaaagatgtctaagatacagaaaggaaatacaccaagttgaagaagagaacacataatgcccagctacgtaaacacacacacacgcatacacacgcacatacacaatgctggcaagtagagaaatagtgggaaatgagaaactttcttcccattataactttctattctgtttttcaaatgtacatatttcacatttaaaaactgattaaacaacacatgttaaatgaaaagctgcagaatgatcatttgacacttgtatggaagacgggcttcaggcagataaggctagaggcatgagagtgggcctggctctgaggtacacatttatcaacacccttataacaactagtgagaagcatattactatccccgctctgcaaatgaggaaactgaggcttagaggaagttgtccagtaaggaagttgtccaaattcccagcatggctcagatttgaatttaggagtgtttcaccacaatattcaagttcctcccaaagcaccattctgatatccctttagaaagtgaagctatttgcacatgggctggccaggaccagcacacagtcctgcacatttcaccttgctgactccccctaccaaaacctaccaaaacactttttcctctaacgatgacaacgattcagtgatccacagactcaagtgaacctttcatcacactaaagcttcagagtacccaggacatgcgatatttaaatcaactaactattgtgattaaaagcagattctcacaatcaccctctgtctcaatgcttgctgccgacatttttttcattaaattgttctgttttccagctgggcaagatggctcacacttgtaatcccagcactgtgggaggccgaaggtgggaggatcacttaagcccaagagttccagaccagcctgggcaacatggtgaggcttcaactctatattaaacaataataataataataatagtaaaaatctggccgggtgcggtggctcacacctgtaatcccagcactttgggaggctgtggcgtgtggatcacgaggtcaggagacggagaccatcctggctaacatggtgaaactccgtctctactaaaaaaatacaaaaaattagccgggtgtggtggcgggcgcctgtagtcccagctactagggaggctgaggcaggagaatggcgtgaacctgggaggcggagcttgcagtgagccaagatcacaccattgcactccagcctgggcgacagagcgagactccgtctcaaaaaaaaaaaaatagtaaaaatttaaaaagttctattttcctactgtaattctttattctttcttttctttttttttttttttgagacggagtctcgctctgtcgcccaggctggagtgcagtggcatgatctcggctcactgcaagctccgcctcccaggttcacgccattctcctgcctcagcctcccaagtagctgggactacaggcgcccgccagcacacccagctaatttttgtatttttagtagagatggggtttcactgtgttagccaggatggtctcgatctcctgaccttatgatccgcccgcctcagcctcccaaagtgctgggattacaggcgtgagccaccgcgcctggcctcctactgtaattcttatgaagaatagcttggtataacaacgtaatctttctttgataatcaagaaccttgcagctctcagggccatcctctgtagttcttaagccacagtatataccacaatacagaacaactagcatttggttatcacttcacccactgttggatccataggaccctgcaaggatctccgtcaccagccccacttccaggcacccaggcctgcctatttccctctcaatcccccactcccagggccctgggtaagggcttctcgtggctccttggaccagcgacagcagaagcattctcccagccaccatttctgtgacttccgaaccactgcacacatgccactttagaaagagaaatcactccacgtgagaatatgtacacaaatgttcacagcagctttatttttaatagtgccaaactagaaacaacccaaacctgtccttcaatgggtaaatggttaaactaactgctgtatacccataccatggaataccactcagcaactgctgaaacataccacaacttgggtggatctcaggggcaggatagtcaacgaaaaaagccaatctcaaaaagtcacatcctgtataactccatgcatataacattcctgaaaagacaaaagtatagagatgcagactagattagtacttgccagcagttatgaatggtggggaaaaggggctgctgtggctgtaagggggtgggacaaggagatatctgggatgatgacatagttttgaatcttgattgtggtagtggttataggaattttcacacgataaaaaatgacaatgaactctatacaccttgctccgatgcccaatgtcctggtttagacattttactacagttgtgtaaatatgtaaccgtgggagaaagctgggggaagggtactgggacctctctgtgccatttgtgcaacttcctgtgaatctataattatttcaaaatatggaaagaaaaaagagagatttgttgaaagtgtgcagtgatcacaccattctcccatttgaactccttcaacagtgactgactgcctggagaataagattcagttccctagcacagcacaggagatggcagtcctctggcccaatcttaggcaacatcaaaccacctgggatcagcggacacacccagctactgcacaccttcaggcctctgcctaagctgttccatctgcttgaaatgacttccctcccctttttgacctgctggtcaacattcaccctccttcaaaaatctagttcaagcacttgcttctcttacatgtttcctcctccagcctttcccttcaaaccatgctgggcatgcccccatttttgccaccctcccagtattcgctttagattgcattccgagtctacttacacttctactctgtaagggcagaaaatgtgtctgatttatttctcaatcctctactgattacacagtgggtgcccaaaaaatgtttgttaaagacaaagctaaatgggagaaaaaatgcggtagggcagctgggagcagtggttaagatcgggactttgacttcagactcccagtgggtctgctatttatctgggtgatgtgcagcaagcgattgcactcatctgcaacacggacgagcagagagcctcagggtacctctagataagaagtgcacagcccacttaggaaggcatcttgatgcaggaatgcaccctaaatctgacgaagcctcgtctagatccaattactaacttacagagattacagagaaacacattcaattacactgcagagatgcaatcaatcaaataccaactatggaaatgctaaggaacaactcgattgcttcaacaaataaactaccaagaaaacaaagaaataggagggggatctatggattaagagaaacttaaaagacgtatcatccaatcaacaacgtatggccttctcttgctctactttcaaactattaaggaaacctaaaattcatggggcagctggaaatttgaatattgactagttatttgatgatattaagcaattattactttttcaactttaaaagagtcagtacctttagagacctaccgaagtgtgaagtataactactgtacacctcctgagcaccctgaggttgtgcccgtatgttttacagatgagtgcaatcgcttctgcacatcacccagataagcagcagacccactgggagtctgactcaaagtcctgatcttacccactgctccgagctaccctaccacatttattctcccatttagctttgtctttaccaaacatttactgggcacccactgtgtaattagtatcccaaaaaataatgaatgaaatgacatgatatttaggatttgcttgaaaataattatgggtggtaagggtgcaagtggataccattagagatgaaacaagattggtcaggagttaataactgttaaagcaggacactattctgtttattttgtatatgtttgaaagttcccataataaaagttaaaataaaaagaatgatgttgaaactggttcatacaatcaagtacaaagtatcaggaattaattattctgaaggaaaattatgtaaaaatggcaccttcctaaccaagtgtgaggtgtaactactgtatgtatgtagaccaaaaatagttgccctattggcaaatcaatagtctcaagaagaaaaaaaatctggtctctgttttatcttatgcctcatgaaaacaactggtttactcgctattaactggtttgtctggtccttttctttatccagaaaattaagaatattttatcttagacacattcaagtatcccctctgttgtttatttacgggaccaaataaacagattttaatctgtgaacaaattaaagtcctggcaccctgaaaattaaattgccaggaaaatcaaagctgtcaaaagagaagtctatgcaaaaatagtattgtttttaactctgcaggatccttttgaagaaaaaaaaaagttaaatggaggaaaacattaaatagattggtggtcattcttccagaacaagttaaaagccaaaagagaatactcagagctgagggacccaggaaagaatccttatctgggaagtgatctgggttcgaactccactcaccagctgcttgctaagaaacagactacttagactcctgagcttccgtttccacagggctccagttacaatcaaatgagtatctgggctggcacctgggcaaacagggcctggctcccctggccttaggctacctttcctgctctcctcacagctcctccctcccacacagccagtcctggaggatgacgatcctgcaaccaagctgaatgaatctgtatttggcttggctcacagcattaaaaaaaaatttaattagctattgccaacatttaaaaatcagaacaaatgtggagtgctgccttcctttttagagacagggtcttgctctgtcacccaggctggagcacagtggtgtgatcatagctcactgcaggctccaaatcctgggctcatgggatccttccacctcagcctcccaagcagctaggactacaggtggatgccaccacacctagctaatttcttaaaattttttgtagagacagatctcgctacgttgcccaggctggtcttgaactcctggcctgaagtgatcctcccacatcagcctcccaaagtgtcttgaaattactggcgtgagccatggcacccagccaaattccaccttcttctagaaaactgctgggtaaggttcctgttctttagggtccccacgactctgtgtccttacacctggccctccagactgattctcaactccacagtggcctacggtccttccttggccctgctccttcacacctctgtgcctctccctgcctagcaaatttcttatcaccctcaaggccccccagcaccacctgtcacctcctccacatttccatggcatagcccctcccctatagcaagggttgtacagtcctggaactaagtgtctgcatgcctgccttctctactgggctcctgggctctctcgggaaagggaccccgttgctatctgccttgtgtccgtagggtctagcagaaagcatgacctagataatgcagaattcagtaaatgtctcttgtatgtgtggaagaaagctacagctaaactattataaaaatgtgagattttatatcacagcttgttccaacagttagcaattaaaggggtcaaggacaccaaaatgtttcacaaaatagaacaagcttccatctgcttacaagtttcacacgctaatcagaagtcactaaatgaacagataaagcagagacaacaggcaggctgggccatttctttgatcattcattcattcattgagctgatactactgaatacttcctgtgtgctttctaagcactggggataaagcagtggacaaatcagacagctacctgttttcacaaagttacatcctagtcggggagacagaaaataagcaggcaaataaatagaatagtttcaaaccagatgagagctaggaaggaaattttttaaataatgaaatagcatgactaagggaagaaagagggtggtcgaggagggcctcacccaaaacgagacatctgaccagaggaaggagcagaaagagctacttgtgccaagatcacggagacaactccaaagacggggaaacagcaaatgcaaaggtcctggggcaaatgcgggctggcatgttcaaggcgggcgagatgagtgggacggggcagcagtcttctgggggaggggcgcggtggtaagggattcgggctgggtcccctctggcactgctggacaccgagtgtgcaatgacaaggcaagagaggagtgcgcggggaggcgggaggctgggcgggtggggagggggttcctacaccactcacaccagcacgggccagcaccctgcccagtcttccacagatgcacaccggggtcctgcccaggcgtctgcatacattcacacagcctgacaacaaccctgtccagaagagacatttccccaccttcccgaaggcaaaaccgcggcagagcgagggtcagtgccttggccaaggtcgcggggacgcgaccccgggcccctgggcacccggcgcaggagtgcagctgtctgccccacctccgggagggatggcgcccgcagaccccacgggcaggtcggccgggccaggccggtgagcaggcccgcagcccggggctgctgacagccgggcggaagggggcgcctgcggcatcccccagcacaggggcgacggctgcggctgccagggccccgcagcccccggcccgccccgaagcccccggccgcgcggttccctcaccgcccctccccgcgggcccggcccgagcagccgccgccaggcctagcccgcccgccgggctcacctcgcctccccgccgccgcgccacggggagagggcgggcgggcggactggcggcgctgcgtgctagtcactcctggctccgcggccccggctccgccgccggcccgccccgctccgctccgccccgccgccgccgccgccgccgccgccgcagtgggtgtgaggggcgccggggcgctgcgacccttccggtcccgctcccttctccgccgctgccgccgccgc

SEQ ID NO: 225 - DNA, 58477 bp, Homo sapiens; identical to SEQ ID NO: 224

SEQ ID NO: 226 - DNA, 58477 bp, Homo sapiens; identical to SEQ ID NO: 224

SEQ ID NO: 227 - DNA, 58477 bp, Homo sapiens; identical to SEQ ID NO: 224

SEQ ID NO: 228 - DNA, 46044 bp, Homo sapiens
tatagcaggaattttaattttacttactaaaatgcaccaaaaagtactcacatttttcatttttgtactttttgaagaaaacattttgtaataaaacaaggaatggcacaaaatgagtaagaattgagacaaactgaacattaagtagatatttctaaattattagtcttttaatttttcaacttttccctttttaattaagtttacttgcaaaataaagacgtccttatttataggttgcaacaagtgaatctgagatgaggctatggaaactgctagaaaatttagtagaacaaataaaataacttgacatattatataatctatgatatagaaaatgtaaagaaaggtaaataaaatgagagaaataaaaatattttcactttaagtttgcactgtgaagaatttataaggagaccactttgataaaattattaaaatctgaaattattttcctaagatacatacaaaacactgactatggagcttgatttccttaaaagcaaccatcaatctgcccaaggatggagaccaatttaaactttcataacgaaaacaaagtcaaagactaatgaaaaactaagtggttaaaacacaaatgaaaaagggaagatgtgaagaaccatgttagggtaaaaaatactgaggatggaagaatggcaaatgaggaaagaaggctattgtaacaattagagtagttattctcctttctgctgtatctctaacatgacttgctgactacagtatgagtttatctctttcattttacatttattttgacttccccagtgtgtcacaaaataacccactagacagatttttaaaaaaaattctacaaaatgtcagcacagtaacaaacaagaaagtttaacatattgttcctcacaaaattttcattttaatctctttcacttaggtcctttgtaatgtgcttcagttcttactttgggggaaaatatttcaatgcataccagtaactaacaaaatagtacttaattaaagcacacaagcacactagcctattaaatttagatagcatctttcctagttaaattaacggaataaactaaataatacagtattttcatttaaatatcagaatatacttatcaaagagtaaataatttcttctatgtgtccagctatttttggcaaaattaagagctaatataatcggtttaactgaactctaagtctcaaagtcatcacaggtagtcaagttaaaaataaagaatgaaattgaaccacttggcttgtgacactaattaacaaatacagtaaagccccccttagaacacagtctggagtggattttacgactttgtcctcgtgagcgctcgtgtaagcaggtggtcatgctgcctgaggcattaagaaagcatggcggggccaaggtcgcggggaaggatacggtcagtgccttggaatatcacacaacctttcaccagctctcccatgatgcaacccactgaccagatatcaactgaaaataaaatgaaatgataaaattatgaagtgccatgaacaaaacaaaagtgaggaaaaggaattctaacagtgcactaaacacacaaatatggaaaaataaattgctagctaagggtgacattttacacaatatgaatgattgctgacctctattttagccttcggtttgtagcaatctggggttttagtgccaaagagtccaatactttatagcttaaaacaaacaaacaaacaaacaaaaaaccagaaacaagaagtgcctgtgaacacaaagcttttcagggccacacgcccaccccagcctccatggccaagtaccgggtcccctgtgaaggatacagtctcttcccgggaacaggactttatggaggaccatttctgccatgatgcacccgacagaccagatgtccactaccaaacaccaggggattaaaaaccagctagagtcccccatcttttttcttcaaaccccctcccaggacaaacccggtacacgtcactagcttgccggcgggagcctctgtgcgttgttgataccacacctcctgagcgatcattttctagactgccccgtcagaaaggcagcagcactcactggcggcacaggctggctggcttgcaggactgcaggtgaggccctgctagaggggcccagacttccacggtgcccaccctcatctgtggggcctcagacagacagcagaggcctctaagtgccctgctggcgggccgaggggagaagtgaacaggggatcaagttttctctcccctccacaggaagcacatgaagctgtgcccctcagggtgggaacacaagctacaacgcagcaagatgaacctgtagcaaaactcatttcagatgacccgggcaaactttcagtctttttaaaaataagtaagcgtgatttcgttattttcaacaaatttgctaaaagccaagtttcaaagagctctgatattgctagaataagctaagttttgatgtaaaaagacaccaattttacatgaaaacatgtgttattctatttacatcaaattcaaaaaaacaatatgcagaccaacaaataaagctgatccatggtactggagatcaggagattggccagcctcgtgggctgcgaggaggggccatggggaggccagagctgctgctgctgtgggtgtgctcacctcagctgagctgcacactcaggatttgcacacttggctatagacagcttaactctgattaaaaagttcaaaaataacaattttaaaagtgaatttttaaaagagaatgattttaaccaatggaaaaacacaattaattatttcttatctctggatcatgctatattctgggtgtaacagtccccacagtatatatcatatggttcaaaggaaagagaaaaaactcgagaccaccgctagagcaatttctaaacatcccagcctcttccagccccggctatactcaccgttctctttgtagcccatacccaggatgacttcgggcgcccggtagtaccgtgtcaccacgtaaggggtcatcatgaagttagtgcacgctgtccgggccaggccaaagtcaaggatcttcagggtgcagtctgatttcacaacaatgttgctaggcttcaaatcctaggaaagaaatggcttaaattagtaaaatgaatgaagcatgctaaataaactacttcacatccgtgagggtcgtgaagccagtgtgagagtgtagggagtgaactgaactctgagatttgggaacaactttggaaaatcttactctcaaattgaaactaaaacaaatcagcctaaagccgtcagatggtgccccttacccccagtggaaaccttcatggcccccatttgccctttctgtggtctcgcaggccctcaggctgtcctatctaccctccatccatgcatctacacgtccagcacacatgcccccctcccgctctccacgcctggacttgagttccccaatactctgactctctcttgctaaggtcctcatgctgtcagtccagcacacacggccccctcctgctctccacgcctggacttgagttccccaatactctgactctctcttgctaaggtcctcatgctgtctgtcagtccagggcagtgctgtcccacagacaatgtcatataatgcgaacgatgtgtataatttacattttctactagccatgctcaacagcatgcagaaataggtgaaattaattttaatcatacagtatatttttttaacccaatatatccataatattatcatttcaaaatgtaatcaacataagaaaaatactgagatattttacattctctttttagtactgagcctttgaagtccagtatgtattttacaactgcagcacggccacatcctgagtgctccacagcctcctgtggttagtggctgccatactggacagcacaggtctagaatcgtctgatcctggaatcttcccatggctctttctctccttggaagagcaattccatgatcatccacctccaatcttctcaccttcgccacaaagacacgccagcactggtgctgctgtctccatctgtacgtggcacaaaaactcacctgctcatgttctggttgccacctctcttccctccccagtgctgactctgtgtgagctctcagcactcagaagcacgcctggcgcgagcagacacttgggaagtgtctgcagaatgaagacatgcatcatattccacctgacttgcaaagccttaacacaacttctgcaaccttttccctcataactaagggattttcttcctgctgatcctccaccctagccccttcctcaggccttaggaatttgacttttgcctggggacttcggcctgcaaactcacttgagaaactgtgacttgtaaacaacccacacccattcttttcacaagagtagtgcacctgcaatgtcaaactgccaagccactgacatggcgtaaggcatgaggatactttacccaggaagttgcaggttcagtagcactgcctagcacctgcctgtaagacaccccaactgatgggccacaaggggggttgcaggcggcatgcctcagtgaaggctgtggggctgtcatcagggcaagcaggaagccatttcgacattgacaacaggtacaattacactgccatgctgctaagtgacctgtttctaggcttcctagattctgtaagatttaaatgataaacatataatgtttaaaaatgcagtcacaatctctacctggccccaaaaagaggcccccagcccctccattccaccttagagtactgtgcagacacccccggttcccagaaaggcctgagaggaagaaaccgggctgcctccctgcatgaaggaaagccagggagaagcagcccacattcaaccagggacgctccgctgtgaggaccaagtcagggagctaagaccaaatgaacgaattcgcttcttgtttccttttttaaaatcaaagagtatgacaagaacaggcattttagaacataaattactaacagataaaataatgctcaatctcacaaaaatcttctttaaaaacccaaaatgaatgcccatttttagtctatcacttggcagcgatggaaagcaagcagactcggtgctggcgggagaagcagaaacaggcgcttcctcaggccacagagggtgtgcagtgggcactttctctccaggaggctgatttctgaggtgtgaaatgcacacacttccccagccagcaggccctgaagcccagcccacccagaactaacagcacggccgcaggagcaaggaagacaaggacagcctggttctaccaaggacagacgcagcagtggaaccatctccacgggctgcctgccagctctgtgaaccccagtgcgccagaaacacgctcatctgaagacactgccatctgtcaaaaaactgtcatcacatactaatttaacaggaaaagcacactttactgccgtctgctggaagactgtggtgataaagtcccaagcttgtgtgggtgctctgtgtggccaatggggaggtggctaaggaggtgctctccccgcaccctgggaccctctctagtcacccccgaaatacaacctgaggcagcttcccaacacctcacttcaatttcaagacagcagaggaaagacagttctgccccttcaagtcttgaaaatcactcagaacaaagaagacaaatgccaagtacagatccaagtgacgcctggatcggggcttggctcccaaaatgcctggaacccaacgctaccctgtgggcagcagtgagggtacccacagcacccgcagcatgagtggggcaggtgctgacctcccccactgcccgctcaactctgggatccagacccactgcttgagaggtatcccaggaaggagcacatcatgacaggtgtccactgtctggccttgccggtccttccccacaggtacctgtggccacccaccgggtaagaacagccaggcactcttgaggatgaatggacacagctctaagtagacactgaaacccgaagaccccaaacactctcagggctcctccacttgcagggttcgtggggtcaggggtcaggggtcagggcataagtgaagtctgggccaggtctcttgcggccatgttatgggagggtgggaacgttagcaaaggcttagagcaaggctgtgagagaacattgctgtccagcctgcagcagtgtgggcgctgtctgggcctctcttctaatcagtgtggaggatgcatttgccccatcaacatgccagacctgaggccttattaatctgctccagcaacaactgcaccttgacatgcacagcagctgcggccaggactgccagtgccgtaagcctgtggccgtctggggtcattctccagaatccatgcagcttcttcaagggctggactaacgagttagactgggatgcaagataccactgtctctgctcccctgaggcttccatggtggccctagtctcctccacccaccccgggccctgcagggtgtgatcttgtttttgatttactatcttgggggcagtttcaggtttccatttggccttcccactgtgacgactcttactcacaggccaaggaactcgtgtgggcgttactccacctgccaagcgcctccgctccggctacacactgaggactggggagacggccactgggtggcctgggaccctgtggcccactgagagccaccagacacagacggctcaggaatgaaggcctgggacacaggccaggcaagccacagaggcctgccaatgtgagagctgagggtatgaataacaggaaagggtagggaaagagccagcagagagaccacagtgacagggactacagggtgtcccactaacctctgtcttccagatttcccctgaggaagagagaaccatgggcgccacaggaaagccattcccaacttatgtggagaagtagagctgagggggccagggtggactgtggggtccacggaaatgcactccttggtctcccgccacaggagtgagagtgacagatggcccagtgtggtgtctgcacctaccctctgtccctgccagggcacacctcccacagagccgtcagccaggggccgaccgggcagggatgctgaggcaggcccgttcctgtgtgacaccggaggccctcagagctgcaccgcagtctggaccaggcctctgaggggccaggactgcactacgttcagctagcatttgctgcctcctctggctgctcccccttccttctcgcacaggcctcctcccggccagtccctcgcctgtctaacccaccgtggcatgcggaagccgcccacgaaaagccccacgctacagggacaggaagctgcagggccgcccaaatgccctagctgagcgaaggaaatgccaacctctataaatggccacgacacccaggaaaggctcagcaagtgaaatgcaggtgctatggaggcagaagaggcaagggtagcacttggagaagttttcattttattgaaagtccaagtacgtagtagatgtcccagatccccatctccatcccagaagtgaggctccactccttcctcactcctgctggcccttcacgcagagaaactgatgcccagcttccaggtgcagggccacaggcgccgcatgcacagtcctgtgggtaccaacagggaaggcacggtgaggcctgcctgcaacagggctgcctggtgagtttgcgctctgccacatgagaagcacagccctgtaccccagcagccaggcttacatccctccaccaagggactgaaggggccttttccagagaaattaaatggtgcccagagaaaaaacctacagaaggtgacacctgtggctgcctgtggtccaagagacacccattctttaacaatttacccattcactcagtacttccagtcagcctttaatgcttcaatctcttttttttttttttttttttgagacgaagtctcgatcttgttgctcaggctggagtgcaatggcactatctcagctcactgcaacctccgcttcctgggttcaagaaattctcctgcctcagtctcctgactagctgggattataggcacctgccaccacgcccagctaatttttatatttttagtagagacagagtttcaccatgttgaccaggctggtgtcgaactcttgacctcaggtgatctgcccgcctcagtctcccaaagtgctgggattactggcatgagccaccgtgcttggcctaatgtttcaatcttaaacatgatccaaccagacatttggggaaagccttgcgtgtgacagggagggacctaacacactaaaaagggaactctcagtagagaaagacaatgcagggagtgataaaacccttcaacaaaagcttatcctcagagatgatagtatatacatgcaacaagaacagaatgctgtaaaaaggaacttttaagagcaaatgagtgtcaattaactcgtgcttcagagaaaaagaataaagaatggagttaagaggacattctgaaagaaatgatataaatttctcagacctctataatatgtgcttccagactgaaggccaagtgcccagcaaaactaaagaaaaaatgcccacatcaaggcatacatcaaaacatctcagaatacaaggaataaataactgagtttaaaagtttccagagataaaaccaaaccaaaacccaaaaccacagcacttaaaaaaggttagtcatcagccaggcacagtggctcatgcctgtaatccagcactttgggaggccgaggcgggcggatcacgaggtcaggagatcgagaccatcctgggtaacaaggtgaaaccctgtctctactaaaaatacaaaaaattagctgggcgtggtggcggacgcctgcagtcctagccactagggaggctgaggcaggagaatggcgtgaacccgagaggcagagtttgcactgagccaagaccatgccactgcactccagcctgggcgacagagcgagactccatctaaaaaaacatcagatggcactaagaaactccggagccatgctagatgccttgctaccacaggcactgcctccgccattctgagcgcaactgatctgtaactaagaattctacacacatctacacacaaccacactactcatcatgtgagagggcagaataaagagtttcagacatttgaggcctcaaaaaatttctctcccctgtggcaatttaggaagcttttggaggatgcgtcccaccaaaacaagggggtaatctgagagacaaggacagcaagcaaggaatccaacatgggaggcagatgaaggaaacccccacaaaatcaccaagggagatccaggacagccccttcgagcaggtgcagtggcagccagtgcaaaggggaacagggctgaggcttgggagaggttcctgagaagatgaaactgatgaaatacccaagacatctacatgtgctgagagaaaattcagatgcctgatggaagagttagggttgaattaccaccaagaacacagaaactaccccccaaaacaaacaaaaacctcacacaaatagagtataagtgtttgttaactccagggaacaaaaggtgaaaggggaaggtctgctgtgcaaagcatttacacgctcacgatgacgcaacgagccaaacaccatcacatccaccagcctgggaggagggcgaggaaggccgagggtgagggctgggttggtaagaagctaaatcagcatcttatgccccaaactgagaaaggatcaatgaagaaagagctaagcatattatttcaatatggaaatagagaccaaaataatcagctaaatgaactgaaggagtttgcttctagggagagagaaataaagggagaggtggaggtatctgtttttcataaatatttatagaaatatttgatccttgatttaaaaaaacaaaccaagctacctgtttaggaagttgctacgcagttatatgcaaggtgatcctgtctttgaaggatgtaagttcaaaaggacataagtacagatatgctggtgttaacatcagtcaacagagaggtgccatgcagagtgaggcaggacatgcaccagcgtgctctcactggccatctccaggtgctaacagagggctgggttacttgcatttcattttttgaattatataaagtatatacttcggtgggatatcatgggcaaaactttatctttcaaatacttaaaatttatgttttgtattaaaccattttaataggcaaaattaaaagtgtgtctatctctgtgcatggtactgtagatggaacaaaggatggtgcagtccacacagaacagttaacttagggctcctcccttcctgggatgtgggcaggggtggggcaggggggcagggggcaagagggagtttccccctttgctttatacacctgtgcaatgtttggaacttccccacagtgagcatgcatcactctcccacatggacacagatgtggggagagcctggcaaggccatggatgtgggaagcagcagggaacaaggtgacagggaggagaggacacagcaagatgccaggtgggtggggatggtgagcaggaggcagggatggcaacagggccattttctgaaggcttcttaggtttctatacctcgtgctgggcaaaccaaacactcctttgggccccatctgactcaggctgcaggcaccggctattccataaaaaaggcctgccgacgctgcagctctcacaaagcccccagtgacaggaggccattgtttcccacttaccttggggcccaagggggaacaagtcagacaaaccatttccccttataaaatgaataaggcctaatgtagtaagactaataatctgggaaattattctaaagcataaataaaatgtatttaagagatatcaagagtaccttaaattatatgaaggtctgtggaaacttcaggaacagaaatagaatggtacatcaggagatctttaattcagaagcctagtgttactatttttaaagcaaagtcaccaatatattattttaactgaccatctgatggcagcaaaggttctattttaaaaaacagtacactagatggcagatgggaggctgtcagctagccctgggaggacaagagctatccctgacgctgcccttgggccacagacctgaggcttgagacgagacaaccctgccctctgtgggtcggtgggctctacccccaagggaggccttcaatggctgtgatggaaccaatctttcctggcaaaagagatctgaaaaaattattaccactccaccatctaaaacccatctgcttatttctgtagtaacaggctctgctgttcttgtctctcactagcttcttccccacagatttcagttcagcaaaaagatgacctcttgctgttggaacataaaatctaatggcaatctgttgataaaattagtatagtaataatccagggaatgctaagaatatctatttccgataaaattatattatctctgcctctagtctcactcagtattttaattgttttttagaaaaaattcgggccaggaggccctaggtggctctgccacagactgtcaccctgtgaccttggagatccctaagcaggatgccatagaatcctggaagccaggaaatggaaacaaatgggaagaccagaacagtgaaagtcatttcaataattctggaaaaaatttatgaagtcctatgggagaaagactctgtgaatgtaaagaaggtagtcattgtggagaaatattcggccagattccaaatctgaacctgaagaagaaaatttctgctgatgtaaattcatgtgaatgcagagtgtgtggacaagtcttcacatgtccttcatcccttaataggcacatcttatctcattctggacacaaactacatgcatgggagaaacgtggggtgaagccatacaaatgtaaacaatgtgagaaaaccttcatttctctcacaaatgtccaaagacacatggtaacacacactggtaacaggcctcataaatgtaagaaatgtgggaagacatttaagtttctctatttacttcaaagacacaaagtaatttacaacggagaaaaaccctgtgaatggaagaaaggtggtaaagccttgagattttgcagttattttcaaaaacataaaagaactcacagtggggaaaaaccttataaatgtcagaaatgtgagaaagcctttggacattctggttaccttcataaccataaaggtgctcatgctgaagagaaaccccgtgaatgtaggaaatgtgggaaacgattcagtttttgtagttactttcaaagacataaagagctcacaatgtgaaaaatcttccatgtgtttaagaaatatggtaaaagactcactctttccagttccattcagaaacataaaagaaataatactggagagaaaccctataaatgtaagaaatgtagcaaagccttcagtcatccccgctccatgtgaagacatcaaagaacacatattggagagaaatcctataactgtaaaaaatgtggcaaagccttcagtcaacacagttcccttagaagacatgaaagaactcatactggagagaaacccaatgaatgtcaaaaatgggataaaggcttcagtcggttcagttacctccaaacacatgagagaactcatactggagagaaaccttatgaatataaaaaatgtggctgggcgcagtggctcacacctgtaatcccagcactttgggaggctgaggcaggcagatcatgaggtcagcagttcgagaccagcctggccaacatggtgaaatcctgtctctactaaaaaaaaaaaaaaaaaaaaaaatagccaaatttggtggcaggtgcctgtaatcccagctacttgggaggctgagacaggagaactgcttgaacctgggaggtggaggttgcagtgagccaagatcacaccactgcactccagcctgggcaacagagcaagactctgtttcaaaaaaaaaaaaaaaatgtggtaacaccttcaggcattccagctccctttgaacacatgaaaaatctcataccagagagaaaccctttgactgtaaggaatgtggtcaagtctttagacatttcagttctctaagtaaacatgaaagaactcacactggagaggcaccctttgactgtaaggaatgtggtcaagtctttagacattccagttctctatgtaaacatgaaagaactcacactggagaggaaccctttgactgtaaggaatgtggtcaagtcttcagacattccagttctctacgtaaacatgaaagaactcacactggagagaaaccctttgaccgtaagggatgtggtcaagtcttcagacattccaattctctatgtaaacatgaaaaatctcacactggagagaaaccctttgactgtaaggaatgtggtcaagtcttcagacattccagttctctatgtaaacacggaagaactcacactggagagaaaccctttgactgtaagggatgtggtcaagtcttcagacattccagttctctatgtaaacatgaaaaatttcacactggagagaaaccctttgactgtaaggaatgtggtcaagtctccagacattccagttctctaggtaaacatgaaaaatctcatactggagagaaaccctttgactataaggaatgtggtcaagtcttcagacttgcaatgtggtgaagtcttcagatattccagttctctatgtaaacatgaaagaactcaaactggagagaaaccctatgactgtaaggcatgtggcaaagcctttagatattccagtcctgtatgtaaacatgaaaaaactcatactctgtagaaatcctgagaatgtaaggatttggggaaaacattcagttaattcagttatctttgaaaacatgaaagaaattatactggaggaaaaccgtataatttacataacatgcatatgaggaatgtgatgatgcctttatatgttccagttacctctgagcacattaaaaagcacatggaactcttccatttccctttgaaaatacgaaacaaaactactactgaggaaaaattctatgcatgtaaacaatgtggtagtgtcttcagtctttccagttctacttgaagacataaaagaactcatttctaaaaaaccctataaatgtaaagaacgtggggatgcctttgtttctctccggcacattgaaagacatgatgtatgcaaactggagatggatctttaaatacaagaaggtattctgtatctaaaccctagtagtttgcaaataaattttcattttaataattatttcaaaagtcatctgagaactcccactgagaacaaatcttataaatttaaggaatttggaaagcctgatgcaaattaaatattccacaatgctcaaaacatgcacatgaatgaaatgttatacaagttataaatatattgtgtttgtcagtggctcatttctaatgaccatctctggactgttgatttccaccttatttaacacgaaaatattgaggtgagaattctgtagataccctttaagcaacatgaatccaataggtagtgtgggtttttttgtcagttaatacaaaattttgtctgtatgtctaaatgtttttggatctacaggtgaattaaaatgtatttctaataagtaggtaacactgatttttatgtagctttttaattgttctgtaatatgtcattgaaaacagattttgttaactgttggggttttcttactggccttatttgacaagttttaattgttcttcacctattacatcaattccatctttcttttttatgaaaaatgtactgttttttggcaggaagaagtttatttcattttctttgctactgaagtattggtatcaaattgtgaaaaaaaaaaatctatcatgatagtctgcttacacagccgtacaagtaataataacaaaaaattgtaaaatcagcttagagagaattatattaattatattatcgctccctagcttattaaatgtttttcctgacagtacagtcacactgttattcaaatcccggcctctgctgagcccacaggcctgctctgaacccttgcggtgcagggtctggccactcccaccagtgatgcagggaagctggcacggcagaattttaggataagagaaatggatatgtgggtcattatttaagaaagagagttctcaagcagctgtctcactgactacttggcctttaagttccttgctcattaaaaatgggatttcacatatggcaaatatattaaaaacaggtgaatgtagataaatggtagttggaagttctctgtcctattcttgaaatttttctctaagttttaagttactttaaaatgaaaagtttaaaacaatgtattcttgcgcagtatctgactgagagcgcagtacctggctgtgtccacagcagctggtctagcctggcaggccaggcggctccacagatgcctcctagaatgactctcttaaaacaccatatgattccatcatctatttggattttcaagcctaacaattttttttaaatgttattttgtatgtaaaggattatgacaaccaaatgattgtttttaaaaataaaattaatacatcaccacttactctatgaattataccagctgaatgcagatgtttaataccacaaagcatctggtaaagaaggtaggacattctttcatgatccagctccatgtgaataacctgacataagttagcatccattaattccataaccaaatacctgagggagaaaaggtcagttatttatttgaaaattatccaaagttcctttatgactaaatttcatgaaactgtaacttacttccaatcactgcactggctaaagtaaaaagataacttggtataatggaactttctaaaaattttccaaagaatatataaataacaaacttaacgtcttacaagttaaaaattaaaaaaaaaaacaacaaccttttatagcatggtaaatagaatctcaaacacaaattttcctacttcttacatttttggctgaaattctccgtaccagcctaaagaccatgctgttacaggctcatcaatcacaacacatgtaccctctggtgggagatgctgagaacgggggaggctctgcacgtaaggggctggagacagacaggaactcagtacctcccgctcaattttgctgtggctctaaattgctctacaatatatacgtttttaaaagtgattatacaacaacaacaaaaaggacacttgaccccactccccgcttagcaacgccccgattctttgctccctttgcaagcaaaactccccaaagaggtgtctcatgtgctatctccaattcttctcccttctttttattttttaaatttttttgagacagggtctcactctgtcacccagactggagtgcagtggcgtgatctcgcctcactgcaacctccacctcccgggttcaagccattctcatgcctcggactcccagaactgaaaattaaattaaaaaaaaaaaacagccatcatgcctggatagtttttgtatttttagtagagacggggttttgccatgttgcccaggctggtctcgaactcctgacctcaagtgatccgcccacctcgggccttccaaagtgttgggattacaggcatgagccactgcactcagccttctcccatttttttcttaatcccacttggatcaggtttgtgcagccaccattctgctgaaactgtcctcctcgaggccactgatgtcttccatgctgctaaatccactggccagtcctataatcccagcgggccctgccctgtcctgtctctaacttctcgctgtcaaaatacccagcaactggtccttgaccctcttctcttctgtaaccacactcactttcttagtgatctcagttacaggccatcagctcccaaattcctacgttcaattcagacatatctcctgaactccaggctcattcctctgcctccctattcccagttccaccttgatgtctaacaggcatcttaaagccatctccagaactgaactcctgattccatccctagcccagtctgctcttctcacagccttcatcatctcagttgagagctccctcatccttcaggtgctcaggccaaaaatctaggtgtcattctcaattcctctctctcataccacacatctcatctatcagctaataccatggctctatctttagaaccatttcagcatccagtctcttcccctctcacccttcctattacccctctgggccaaatggaccctccgtcatcccttaacagaactgctgcaacagcagtaactgatgttccatgcccccaccccttatagtgggttaccaacccagatgccagagttacgcttttcaaacagaaggcaggtgagctcactgctctgctaagactcttactctgacttgccttagagcaaaagacatccttacaacggcctagaggcttgtggtgttcaccctcttctcttcccctgctccctcatctctagccacgccacctcttgatggtcttggaaaacaccaggcgggcatccactgctgtcctgagcgctgtctgttccttctatctccattctacttgcccccaaagtatctgcggcaccaaattctttttttttttttttttgagacagagtcttgctctgtcgccctggctggagtgcagtggtgcgatcttggctcactgcaagctccacctcccgggttcacaccattctcctgcctcagcctcctgagtagctgggactacaggcccccgccaccacgcccggctgattttttgtatttttagtagagacggggtttcaccgtgttagccaggatggtctcgatctcctgacctcgtgatccgcccgcctcggcctcccaaagtgctgggattataggcgtgagccaccgcacccggccagaccaacttctttatccccttcaaggctttcttcgaatgtcaccaactcatggaggtctttccccagccaccttatttaaaactgcagcctcaagtccaaccctcagcacttttgatcccctgacccagctccaccctttgtccacagcacctagcacattctaatggactacatgctttcctcatttatcatgtggcttgtctatcttccctgacaggctccagggaagccaggtaggccaagtcccagagagtgcccagcacacagagggcaatcagatatttgttaatgactgaacacaccaataaattcaggatgaagttgggcattatgcctctcaatagattaatacttcatttcactgttagtaagatgattctacttaagattctggaaatacagaatcttaaatagaattagtgacttaatcattttaagtaatactcataaactcctgaaccctaaaatcctggctatcagggatttgagaaaaacattttatagttcagcaaaacacattagtgatcctggtctgctctgaagaattctttccagtcatcctttatctgttatgaagatgaaaacccatgtggtacaaataattaaatataactatcaaattttctaaatatttctctgcaacagagaaagttatctgtgatgtcacaaaatgtattgccacctacatttcctaagtataaaaagcagttgctgtcttttctagatgttcattctttgatgtacagtgcattactgaataaaaatgatacttacacatcttgaaattcttctagagttttttgtggtgtaaacacatttaacaaactaattatctgaaaagagaaaattaattatacttcaatatgtcagattacttgattacaaaaattaagtttaatattgaaatgcattaagacgggaaaaaaatcacagcagaattcagtacttcttattattactgcttttaccaattacatggcatttgagaaaagttaaacatcaattaaaggaaagatgcacttttaatcaaatcacttttatgtgtccctagtaacttaattattacagaatttaaacacataatgtctttttgaacataaaaaagtagaatttacaggtaaaaagacattaaagcagtatgttaactctgaaaacttaaatactacgcacaaatttctaaaaaggtttgaaatatgaaggctaagctcttgtttttggtgtgataaagtgaaaggcctcgtagcatcatatttttacctaaagagggttaaagagctgatcctgcggcaggcctccatcctggcaccctgacatgatttggctgtgtccccacccaaatctcatcttgaattgtaatccccataatccccacgtgtctagggagagacctggtgggaggtgactggatcatgggggcggtttcccccgtgctgttcttgtgacagtgagtgagttctcaggagacctgatggttttctaaggagcactgcccactttgctctttacttttctctctcctgccgccttgtgaagaaggtgcctgcctccctttcgtcttccgccatgattgcaagtttcctgaggtctcccacatcatgcgcaactatgagttatttaaaccgctttcctttataagttacactgtcttgggtatctctttatggcagtgcgggaacgaaccagtacacagcccatggtgtaaacagcgagtcccacggcttaggcaccaaacacataacctcagtcattccagatgactgagggaaagatgaattatccattatacaggattggggtgattggttagctaaggacaaaaataaaactgcatccatatttcaatctttataccaagaaaaactctaaatggaacaaagacttaaatctaaaacatgaaataaaacctcagaatatagataaacatttatataatcctagcgtagaaaatcttttctaaacatgacaggaaacctaagagatctgattacattaaaatgaaacaaaaaatgggtgataaaaaatcagtatgtcaacaacataaataatgtcaaatggaaaaaaaaaagtaaagggcaatagttttaatatttaaaaaaaaaaccctcctacaaatgcagaagagaccagcagtccaaaagaaaaatggataaaggccataaaaattaaattaccaaaacacataaaaataagtaacaacctcaccaataaaaataaaatatcatttatttatcaaattggcaaaagcaaaacaaaaaaaatcaacagtatgtagtgctgggggattctgaagtaacagacgttctcagacactttttttttttttttgagatggagtttcattcttgtcccccaggctggagtgcaatggcgcaatcttggcttactgcaacctatgcttcctgggttcaagtgattctcctgcctcagcctcccaatgagctgggattacaggcgcccaccactacgcccagctaatttttgtatttttagtagagacggggtttcaccacgctggccaaccaacgtggtcttaaactcatgactcaggtgatccacctgccttggcctcccaaagtgttgggattacaggtgtgagccacagcgcccggctgatacttttttttttttaggagatggggtcttgttttgttgcccaggtgtgccttaaactcctggcttcaagcgaccctcctgcctcagcccaagtagctgggattacaggtgaagtgaccgtgcccagcttctcaaatactcttaatgaaaatatcaaactaatagtcttccttgaggtcaatttgtcagtatattttaaactagaagtgtgtgtactctgacctgacaatgttggccaagaaattcacctggacgagtatgcaaaaattcaggcgttagaatgttcattgcagcactgcttataacagtgagaaacaaaacaatctatccaacaacaggcggctggcagtctcttaaataaattactgtgcatctgtgctatgcaaccatttaaaaactggctcatatctatgttcattaaagtatatgaggtctaccaacattgcacgaggagaaaagcaggatgaagaataacacgattaatcttgtttatgtacttgtgcacatgtatgcataagaatgctcaccaaactgttaatgctagtaatctgtgggtggcggtattcaggagtttttacttttttatattgtttgaatttttaaaaataatatatattttttgtaacctgaaaaaattttttaaataagtaagtaaaacaagtccgggtgcggtggctcacgcctgtaatcccagcactttgggacgccgaggcaggcagatcacgaggtcaggagatcgagaccatcctggctaacatggtgaaacccctgtctctactaaaaatacaaaaaattagctgggtgtggtggcgggcacctgtagtcccggctactcgggaggctgaggcaggagaatggcgtgaacctgggaggcggagcttgcagtgagctgagatcgcgccactgccctccaggttgggcgacagagcgagactccgtctcaaaaaaaaaaaaaaaaaaaagaaaaagtaaaataaagcatgcattagagaaatttaaaccaactcaagccacagactcaaaagaaggaagctcaggagtttaagatcagcctagacaaggtggtaagaccccacctctacaaacaattttaaaaactgccaagcatggtggcgcacgcctatggtcccagctacttggagggctgaggtgggagaatcacaacctgggtgacagaatgagaccctgtctcaaaaaaacaaaacaaaaaaaaccagatttcacgttttatattttatttatttatttatttatttattttgagacggagtctcgctctgtcgcccaggctggagtgcagtggtgctatctcagctcactgcaagctctgcctcccgggttcatgccattctcccacctcaccctccttaattttttgtactttttagtagagatggggtttcaccatgttagccaggatggtctctatctcctgacgtcatgatccacccgcctcggcctcctaaagtgctgggattacaggcgtgagccactgcacccggccaacattttgtaattttataacatggcaacgttatcaacataatgctcagcgaccactaggagaacaaacaatgtgcttgattgaacccaacttcattttctagaaacattatttctccgtaaaatttagtgctttgatttctgtggagcttccaagaatagctactctaaatgtaacatcatctaataacgtgtatttgaaactggtgtgtcatatacaaggtaaaaacctacttatagaacaacatctttccacaaaatatttagttgtttctcaatttgttagatcaatactgttcctattttatagaaacagagtatcaattgatattcctactttggttaagtgacctaaattcctatgcaccataatgatgcctctttctagctttgatttcctcaatgtttattaagaattttatcagccgggcgccatggctcacgcctgtaatcccagcactttgggaggctgaggctggcggaccatgaggtcaggagatcgagaccatcccggctaacgcggtgaaaccctgtctctcctaaaaatacaaaaaattagccgggcgtggtggcgggcgcctgtagtcccagctactcaggaggctgaggcaggaaaatggcatgaacccgggaggtggagcttgcagcgagccaagatcccaccactgcactccagcctgggcgacagagcgagactccgtctccaaaaaaaaagaatgttatcaataaaaaataggccgggcatggtggctcacgcctgtaatcccagcactttggaaggccaaggcaggtggatcatggggccaggagatcaagaccatcctgactaacatggtgaaaccccatctctactaaaaatacaaaaaattagccgggcgtggtggcaggcgcctgtagtcccagctacttgggaggctgaggtaagagaatggcatgaacccgggaggtggagcttgcagagagccgagactgcgccactgcattccagcctgggcgacaaaaaaacaaaaaaacaaaaaacaaaaaaccaatgttaatagccatttttatccttagcttatcctaggtctgaactcaatgtatctccagaaaaccctgaagattaccacattattgacaatatggaagcacacagacaaaatacatacataacttacatttttatgattgacacattttaagaggacaagttcacgataagctctctttgcatgagtttggttctgaaaaggacggcttagtttcttgactgcaacatttatcccaagaactgtatcaaatgcagcactagaattaggaaatataatgcacaatccattagaacggttttggaaaatacagcaatgccagaatatacattgaatatatcatctttttaataagtaacaaggaaaaatctgcttatttcattcaaggtacttgcacatatgaagagcagagtgagttgtctaagactacagcatgtactaactcctttgcagaggcacatttcagccacagttaagatggggttcagcaatccttcacacaccaaggtttcatagtttagattacattcaaaaccaggtaatttaatatagagtgcataaaaccagtcaagaaatgaaatcttcagtttaaacatgacaagaagttggaaacaaagtcactgtttcctgtcttaaaatgtgtatattttggaatatcacagtagaggaaatggctgaattcatgaggagaataaatctaaattttgaatcactgtgtttttttcacaaataacagtatctaaaaagaaaagaagccaaaatttcagctcatggtaaatgttcaagatacaaaatctctaacgtaagcaactgctatataaagttcttttagaactatctcctcctactactatagtaagaataaaatctacaggctgtgtttccagcatctcgtttcctgttgaaattctgttcattttcctccagaaaatagacatgaagaatcaagtagcctgattacacatttttaggtttcaaactggtactaaatagtatcatttgtattatcacctctgggctactcatgagggctaacagctactaaaggccacctgagaacctaagcactgatttaaatactgtttctatttctttattccattgagtttataacattgtttacatttattctcttctattaatgcttttgccaaactcgaacctaattcaatctgttttaaagttgaaggctatctgttgtagcatttggttaagaagctaccttactttaattcagttcatattatgtgtctgtctatatacatatgtaaatccacaggttcatatgcaaattgcaccatttatatgaattataaaatgagaaggatatatccacttgtgaaacaagtcattgacatacatgtagccatgtatgtatttatacctatatacttctcagactcaagaatttgaaaataggccaggtgtggtggcttatgcctgtattcccagcactttgggaggccaaggcaggcagatcgcttgagcccaggagtttgagaccagcctgggcaatacagtgaaaccttgtctgtacaaaaaatacaaagattagctgagtgtggtggtgcatgtctgtagacccagttactcaggggactgaggtgggaggactgcttgagccgggggtcgagactgcagtgagcactgatccctccactgcaccccagcctgggtgacagactgagaccctgttgcccagggtctcaaaaaaaaaaaaaaagaaaaagaaaaagaaaaaaagaatttgaaaacagacacacttttttggtatcaaaagtttttgtccaaaatttcagttagataggaggaataaggtcaggaggtctactgtgagatatggtgactgcagttaataacaatgtattgtattcttgaaaattgatgagagtagatttgttctcatcagaaacttttaaaaagtatgtgaggtaatgcatatgttaattcgctcaatttagctagtccataatgtatacatatttcagaacaatatgctggacatgataaatatatacaatttttatttgtcattttaaaaaagtttttggctaaaacaaggcaaatggaccaagtctaagcatctaagtgggcataagcttccccacttgtagctcagctccatgaggaactaccttcagttattcctggttgtggttattgcggtcactcaaagaatacattgttatcactatctcttcatttatcagctttagaaatgattcacctactccccattacgaaaactgagtatttggccacttccttgaaatccccaatcgccaacacctcctattttttttgttgttctgctttttgggttttccctggttacgtctttaagtaacacccctaatcttcacgcttcttcaactctgaagggaacgtcttgacttctgcttacgtaaaatgagactgttccatccctttctcctccatttaccatatattcataactaagtcttctgtatttcttctttaggatgtttctagaagttgaaaatcaatacatggagtgtaggtgtgtatgtgtacaatgtaaatatcactaacggccagagttgggattacatttcattttctaaagatcacatggctcttgctgccactcataagagggtgagactatttccaggatcaaggacaaaggattctcttatatttcatcaactgctcaaacatcatgtcctctttgtttcataattagaccatgattttttctagttttccccacacatttctaataaataatagattttattacattctagattattattagtttttactaataaaaaatgccagttttagcctatcattgacacatcttagcttctcacattatctgttgtgtggcacctactccacatgatttgcagacactctttagcctatcactggcacttcctagcttcttacattattgttgtctggcatctcctccacatgatttgcagacactcttcttgcagcttccttaagacctgccatgcagccaccatcctgggatttcttttcacagtccccactgcttcttgcattacgctcttgtgttgcctctcttgctggagtacatcctcaaggaatttcctcagaaaaggtgcatggaagatagatggtattgctctgcccccacccttgattgataataagttttctgagtttaaaatcaattttctgtgagaactttgaaggcacttttccactgatttccacactgagtgctgacagtgaggaggcttatgcccgatactgtactgattcctttgcttctttttttgtttcccagctcaatgatttatcagtcatgttctctctgtatcccaaaagcttctcacacccccaactaattagtgtccctcctgtccaccagtgataactgctttgacatgtacaataatcactttcttgctttaccagctaaagcatgcaccctggagctcccagtttatttttgcctgttttttgaaatcttctgtgtctgacttctgtggctcaatattatgggactcatccattgttgctgtatgtagctataactccttccatcattgctataagattcctttgtataactatatcacattacgttgatagatatttcagttgtttttagttttcaatctattacagaacacacagtcatcaccattcctgtacgcagctccggatcccctatgcatgtgtttctgatgagtagacaactaagagtgggaacgtatccattgtatttcagtagataatgtcaaactctttgccagagcgtttctacaaatttgtacagctgccagcagtgcacgaggggtcacatctgagagctgcctctgcgtggttccagtacacgaggggtcacatctgagagctgcctctgggtggttccacatcctcaccagcacttggtatcaccaacagcttagtttctaaccattctgctgagtgtggaatggtatttcgtcgcagttttaaattgcactatcttgatgaataacggcattgagcacttttcctgtttataggttatttgggtatcctcctgtgacaacctattgactatttgtttgtctatctttataatcttcttgactgttgttctttacatattctgaacaagagattttttttcagtcatatatcttctcacatctatgcttatcttttcagtttcttgatcttggttttttaaaataaacaacatttcttaattttaatacaaaattgatcaatcttctatgataatttttttttttcttaaagtggagatggggggagtctcattatgttggccaggctggtcttgaactcctggcctcaagcgatcctcccaccttggcctcccaaagtgctggaattataggcatgagccaccacatccagcagataaatgtttttttatgttgtgtttaaaggagtccttccctaccccaaagatcatgaagacattctcctatattatgttcaaatagctttactggcttgccttatatatttacagcaattcaactgacattcacttttgtgtataatatgaggttggggtcaaatttcacttttttctacatgaacattcctatgtccatttatttaaaaggctagcctttcctcattgctccacaggccaccactgccataagtcagaagcccacacatgcatgactctgtttcagggctagtccactgtttctccttgcaccacacgacaccagcttgatcaccagttttatggtaagtcttcacatctcgcagagggagtgttcctcccttcttaatgggtgtcttgaccattctagggtttttatttttacatataaattttaaaatcagtttgttcatttctttgttttttaagacgactgagatttgattgcaatcactctagacaagtctgaaaaatgaccttcatggtattaaatattctaactctgaaaatcagacatcccaccacgatttcagttttctctattttttctaatttttttagctttttgtatacaagtctttcatattgttagatttttcctccagatatgataatttaaaagtttttatcctattttaagtggtatccttttcaaattttcattttctatatgctgctagtatataaatatgcaattttgcagggggaggggtacatatactgaccctgcatcttgcaaaagggctaaacgtactcattaatttaacaaaacgcagattatccaggtgggcctattcttatcacgagagccctttaaaggcagagtttgctctggctcatggaaagggtggaaaatcagggagatgtgagtatgggaaggactgggcatgccactgctgccttgaagatggaggaggtcacttgagaaggaaaacatgcagcctctgggagcagacagcagcgcctgactgaaagagatcaagagattgggaaccacagacctaaagctgtaaggaactagactctgccaacaggctgaaggagcttggaagcagatacccttccagaacctccatctgtgagctgagcccagcccagtcgaaatcttgacttcagctttgtgagatgctgggcaaagaacccaggcaaacccacccaggtttctgactatagaactatgagataatcaataggtgttgttttaaacaactaagtttgtgttaatgtgttatgcagcaatagaaaactaacaccttctctgttttgggctcttctaccatttttgcctctgcagctttcattctggatactttttgctgacctctcctccaggtcactaaatctctcttcagttatatctagcatgctgttacacatattaaattcataattcaattactatagtttttacttctagaattttgatttattcctcttaaaagaagttttcatttctccaccaaaacttttaatcttgcctttatcaccttgaacgtaatatcatagctatttaaaaatgtggatctaataatgccaatatctcctatggatctgtttcttttgtctgctgtttctgcaggattttattcatgttgtcatatctccttgtgtgcctagactgggccttgcacgtataaaactgtttgctatctagaaataattttatctaatatgatgctgtcttcttccacaaagaatttaaatttatttctactaggtacctgggggcactagcaatttttgtttacccccatacaagttcagcaaatgagatgataatctgaagctgagtggcagtgcctataagggccaatctctgagttacctttacttctaggaagcagccttttattggtcccaacacaagtaaaagaagtttgccacacaatattagagggccctggactctcatccctgtctcctagccacagggcagtccaaaacactctctcaacagccccttccagaattttcaaatgcccccaagggaaagacagccccacatgctgaagctcccctcactaggcttctgtgcttccccagatcctgacctagtaactcctcactaacttactagctctctaggggaaaatgctgagcatgggggacagtgggaatgttggcagaaaactggcacagctgtttcacaggcacacttttaattaacagccctagttttagccactcatttcatctcttcttcattgtcatctctatgcccacagcctctgtagttttactatagctaggttctcttccttacgcacatacttcagctgcttattctcactttatctgctgttttatctgtatcacaagattcaagctactttctatatttcataaatttgttaaaactgtcttccacttattactgccctcttatctttgtacaggtgttcgggccaccatcttaaatgagaagttccaaaccactcattttacaggtgaaaatattgaggcccataaagaaactgatttgccctgctcacaaagaactcttcgctgaggaaaagagctggactcagaactcaagtcttctgaatcacagccatcctgtgcctcaaaccatgtctcctttatcacagaaattttgttgtgaacattgttatgtttttatttatttatattaatagaaaataaaccatgttaagaacaggccagtactcatgtttatacagaacttgaggacacaaaaaggaacacgctataccaattatttcatgttaaggctgtaactgttacttctaagaaccgccagactcaatattgaacacttttttaaaggttaagcatttcatagaatggtttcgtaaagcaaataatctttactattttggccaaacttgagatttttgaaggagaaagaaaaactgaatatatgtatgaaagaaatgtacatacattttctccactagagcttcaaaatcttacaattatttaattgtactataacacagttgatatttatgaatacttcaaaattatattttaaaacttattttaggccaggcgcggtggctcatgcctgcaatcccagcactttgggaggccaaggtgggcagatcacgagatcaagagatggagaccatcctggccaacatggtgaaaccccatctctactaaaatacaaaaaattagctgggcgtggtggcgcacacctgtaatcccagctactcgggaggctgaggcaggagaatcacttgaacccgcgaggcggaggttgcggtgagccaagatcacgccactgcactccacctggtgacagagcaagactccgtctcaaaaataaaataaaatattttaaaatttaaaaacttatttcctaataaattttactaacatatttaaaggaacaaaaacaaataaacaaatcaaagacaactataaaaacaattcaaaattaggaaccagaatattttcttctggctccagctcttccatttaatcctgtacaggtcacaggccctacctgcacgttggtttatctgcacacctgcccttcataaagctctaatttaaatagaagattaactagttgcataaaccatacactgttgctgttatatttctcaaaaatgtagaaatacacatgcttgtgaattagtttcctattgctattgtaacaagtaaccaccaatttactgctttaaagccacacaaacttactatcttacagttctggaggtgagaagtccaaaatgcatcttatgcctcaagaggtaagcagggctgcgtggctccttctgcaggctctggggggagtctgctccctgcctctctcagctggttggaggcttcctgtattgcttggctgtggccccacatcactccaaacttcgctctgccatcacatctctgactatgaccttcctgtctcccttttgtaagaaggacccacccaactaaacctgggataaccctcccatctcaagaccattaatgtaatcacaccggctaaattccttttgccatgtaaagaaatatacaaattccagggattaggacgtggacatctcaggcgggaccattattctgcatgctacactccccaaagaatcactgacagatgattttcaagtacaatagtgatgaaaggaagtttcagatcatcaattaactacataatgccaatattttaatacgaaatatgatagaaaatccaattcctcttgtcagtgttagctaatctactgttgagcttatttttggaaaagcaagcttttttttcttttttgaaacgggaatgtgccgtaactagattatttcccaattctacttggtgcctcatagcctggtgaaggatacagagaaaagagaaaggtgaaaaggaagcgaaaatcacttataaagtgtttactttccctattagaacataagatagaaggataccataaaactgaaagtcagttatagctataaaaattgaaactgttcttgaatgtaacaattgtcttatagagataaatacaattaaatgaaaattgtttaataggtgtttagtgaatatttgttcattattactaagattctaaacagaaggtgggtcagaggccttgacctatcaaagtatcagtggttcaaagtcttcaacaagtctctccgtggtacaggcaataaggtcccaaaggcccacagcttgttttggtcccaggcctaccactaacaccccgtgagacgggagaagcaagtgagccttcctagtccttcgattcaccaccagtgagggttatggcagagctcatggtgattctacaatatacactattcacattactaccaaccttcaaaagcaagtgaatgacatgccagctgggataaatgaagcacgtatttaaaacagctacctgtaggccgggcgcagtggctcatgcctgtaatcccagcactttgggaggccaaggtgggtggatcatgaggtcaagagatcgagaccatcctggccaacatggggaaaccctgtctctactaaaaatacaaaaattagctgggtgtggtggcgtgcgcctgtagtcccagctaccgggaggctgaggcaggagaactgcttgaacccaggaggcggaggctacagtgagctgagatcgcgccactgcactccagcctggtgacaaagtgagactctgtctcaaaaaaataaataaataaataaaacagctacctgtctatagccacaaacaactccccaagacctccgacatttctcccttcttgccccctctctcctttttctctctctctctcgcatgcacacatcaaattatctgtcaaattatcatctaattccaaataggagatgggttataaaccaaaagaatgctttgttgtttataactttccattaccatcaaagtttcctaatttgaaccatcctccactaactttaaaacttttttttttttttttttgagacggagtcttgctccatcgcccaggctggagtgcagtggcgcgatcttggctcactgcaacctccatctcccaggttcaagcgattctcttgcctcagcctcccgagtagctgggactacgggtgtgtgccaccacacctggctaatttctgtatttttagcaaagacggggtttcaccatgttggccaggatggtctcgatctcttgacctcgtgatctgcccagcttggcctcccaaagtgctgggattacaggcgtgagccaccgtgcccggccacctttaacacttcttctggcacactggatttaagtgccgatacagcatgtgtcatcaggaagttaagatcaccattactttagatgcaagctgggcattccttccaaacagtccctttcccgccttagcttctcaaagaagctctggactgcaatttcctcttagctcccagggccttcagccgccagggctgaaaaaaacaactgtttccctgatcataggtctccgcaacaaaggatcagttaaaaatcatcgttaaagattctccaaacccaacatctctacaaggaaatgtaaactaccctactagagcatcgaaaagagctttcttctccctcaaccccctctgcctaccagctgtaaacacgcgatgtttaactgcaccacggtttctttaggcgcaaaggtaatcctgttttcattgaccaaaaaaaaagaaaaagaaaaagaaaaaaaaaagttctgcccagaaaaataaggggtaaaaagtgtgggaagtgctgatagctgcagtctaggaaacatgtgaagagctttaccttgagctggcccgtgatgctgcggcggctgaccgtcttaccatgcaagagactaacgttcagggtcagactaacgattctgacgttctgggctggacacacagttgaagtgagacaccaaggaagagatggccagcccaacccctcacacagcatcccttcctggttaatccatggagtgacaatgacactgactggcctcatcctgccaatgaatggcaaggcactgcaatgatggcgcctggaaatgaacaggagtgatcgggaataaaaggggaggggggaaaaggtggccatgatgaagaaatgaataaaactccaaatttctgttacaactcactgtcatacctactactctgatatcataatgacaggagaaatgaaaaaaaaaatgaaaggaaaaagaaacaaacaaaaaagaaaacttgctacctatttaaattcctgcagcattctaagaatatgggtttgtaccctacagcctgactacacagaactagagcaagcagttgattcaatttagctcataaacctataacagagttttttttttaatcatcaatgtttctaaatcctgacactttagttttactttttattacagcaaaaactcaatccacgctattaaaacagaccatacttaccaaacaatcccttgggccccagagccaattggtttcagctgctggtaacgttttaggacagtgaaggttgagtctgccacttgcacactataaaactgactgtcacatttactgtcgctcatgatgcagcgtcctgcaatatcccgaagggtgggcaagtttcagatcccttcaaagaaaaacagaatgaacgtgcattcttaccggaagtacatacgcagctcacgtaagagagttctgaacttattggtatgtaagacaatgtggctgtaagttgataaagtcaatctgaccaagttctgaacttaagcaagacacaaaaaaatgcagacatttcagtggtaccagaccattatgaaaggaaggaattttgaggcccagcaagaccacactttaaggggctggactagaaaataaccacctttggagaaaagaatgtatgcattactactggctatgaaaagactacatcactctgtgcgtctcatcagcttgccccctgtgggcaagctaggtgtaaatggttcatttacacctagctgtctagagacggaggcattgtttcaaaaatgatcacttctagaatgcctaaagagaagcaaacggaccagtcttctgctcagtgtatagattctggttgaaatgatgaaccaaaaagcaagattcatacgccaaagtgacaggctgtcagaggcctggtggcatcagtgtgctgcatgtgcccaagcacgtgctcctgcctcaggaggtgggtcccagagctggcatcagctggcacagccccagagtcccacatcaccaccggacttcagggtagagatctgtatatgaagaactctgctgtgactgacagtccatcatagtaacactaggaagtctatccactatgtctgagtgtaggccagcaggcccagaaagcagcttttctgtggttgaggcacaggctgagactgctgctctgcaggagcctggatgattttatacagaaaacaagcaaacaaattggcaagtggttcctaggctcgtgtctggttatgcttatttaaaagtcagcaagctatttattttggtcttttaaaactacatagccaacaataaaatcatataggtaaacattctataccgtttaagactacagaatgtattctacagctctgtcaaatcccttgcctttatgttctagtatctaatatttaacgtcaacctaatgagatttttgtggtgatgatttatatttcaacacaaatgctaggattttccttaaacatggaaaaaatggattaataacaagtctaaataaagaactgagtcaaattaataatttctccaagtgaccactgccccacggtcttctccccgtcctctgggtggtggctgcagtgtggctgccactctgaccactcctgccgaggtgtgttagcgtgccagccagggagtgactccagtgacgccacagcgcttagatgctggacaaacagctgctcatacaacccgcaccgcaggagtctcagtcccgtgttacctgggagcaatctagggctgagtgagctggaacacctgcctagcccacactgctgtgagaaggggactcaggagctctccaggctggcaggtcactgtgctctaagctataggaggtgcgaggcaggtctgtcttgctcatggcatctcatactccaaggacaggaggacaggaagctggtctttggggcactgtgagcattcaataaacctttgttgatctgattccccacagtgctgctccattttactgatatctaaaggaagatcctttctaaagattagcttatttacagtttgcaagaggctgaaacaattccactcaacatttagggggtacctttatgcacgaaagtggtaagtatagcaaaagatatgccatagtcagctagcaaccagtcttgaaacaacatgtacttcactatttgggggagaagcgcgagcagtgagtccattatctatattacaagtcacagtgcggtaagggccataagcacaatgtaaacaaaatcaaaaggcaaaagagatcctacccactggcaggggcagaagacaaggacggcttcaaggaggaggcggcatccgccctcagactcttttgccagagatggacagtagagccacagagctcaaactgactgtgtccagacacagcgaactgctgagcttggctagcggggtacaagtgcaaaggattagagacaactcagcaaaaaggcaggcacccactaccacctgctttacggagggtggctgttcctctgctatgccgtcaacacaccagcaacacagttacttgcaagcatgtactgagcacccgctgtggatggtgaggtaccatgccaggacactcgcctgccctcagtgagcgcacactcaggaggaggccctgcacaccaagggtcctaaacccagtagggtgaagaagatttgggggaatgggaggagaagcagcagaggcggaggcacattcggaatgtgacaagtcactagggacttgctgggtagagggcgagtgaagctggagagagaaaaggaggccagatcactatgagccccagaagccacgcagagccgtctggcctcagtcctgagggctgtggaagccgtcaaaacatcagaggtgcgacacaggcgctgaggtgctccaggatccatccctcccttcctcgctttcataagagaagccttccttccccttcctgctagataaatggctgcccaactagagacgacgcctggcagctttcccagcagccaggtatggccagatgaccaagttctgactaataagatgtgggtagaagtgatgtatgcaacttccagatcacttttatttttctttacagaaagctgcttgccctccaatctttcttccttgctgctggctgagggatcagctgtcacagacccagagatggaagtcacatgctgtagatggaaagctgcccaccagctggattccttaactacctcatggcacagagccaccccccattcaggaccccgtgtccacgttgggactgacagatcaatctcaaccctgctgaccaactctgcaactctccctgctataactgctttcaacctatatttggactatgacaatattaggttaacttttttaaatttggggagtatattcactcatattaggttttagaattgtaattccatctcaagatttaaaatagtccgggcatggtggctcacacctgtaatcccagcactttgggaggccaacgtgggggaatcacttgaggtcaggagtttgagaacagcctggccaacatggtgaagccccatctctactaaaaatacaaaaattagccgggtgtggtagtgcgtgcctgtaatcccagctacttgggaggctgatgcaggagaatcatttgaaccgggaggtggagattgcagtgagctgagatcgtgccactccagcctgggccacagcgagactccatctcaaaaacaaacaaacaaaaagatttaaaataattataaaattaaaataaggtacccttattatgcaggagaaaaaagtcacctaagtgaaaacctgttaaagccaccttctctgtcaagtttgggctttgtgagagcaagagaaagaaacttaaggccacctgagaaggtgtgtaatttagctattcatgagtcaactctattgagatgatatttcaacaaaatggaccatcaactggggctcagaaaacagttttacaaatcgggaagtacaagaattcttcatgaaaccacattagcaatacactaaagcctgcattcgctgcctccacttcccacaccagccggtgctggttcctccccctcagctcccaggctgtgctgccaccatccgtccagcacagggctccctccttgccacttgtgcactcagcagcgcccgccaggctgcactgtcacagcctttgtagggtctgcctcccttccaggctatgagcaactcaaaactgggagggaacgctacaaggaggtttcctggaggaggcaagacctgagctcaagtttgttcacagtatcgaccgaggcatgaggaaacaggcactttcatacacgtcagtgagagctgagaagtggtaaaacatttttttagatggaatatagatctggctaataaaaatgttaactgcatatcctaaactggcaaacacaattctctaagtgtatctgacaaatacgtgtacaagtatccaaacatatttgtgcaagcatgtttgtaacacttcttgtaacaggcaaaaaactagaagtaatctaaaatgcacactgtggatggactgaataaattatggcacagaagtacaacaaggccattcaacagaatgcaaggactttatgtatcaatgtggaaagatgtctaagatacagaaaggaaatacaccaagttgaagaagagaacacataatgcccagctacgtaaacacacacacacgcatacacacgcacatacacaatgctggcaagtagagaaatagtgggaaatgagaaactttcttcccattataactttctattctgtttttcaaatgtacatatttcacatttaaaaactgattaaacaacacatgttaaatgaaaagctgcagaatgatcatttgacacttgtatggaagacgggcttcaggcagataaggctagaggcatgagagtgggcctggctctgaggtacacatttatcaacacccttataacaactagtgagaagcatattactatccccgctctgcaaatgaggaaactgaggcttagaggaagttgtccagtaaggaagttgtccaaattcccagcatggctcagatttgaatttaggagtgtttcaccacaatattcaagttcctcccaaagcaccattctgatatccctttagaaagtgaagctatttgcacatgggctggccaggaccagcacacagtcctgcacatttcaccttgctgactccccctaccaaaacctaccaaaacactttttcctctaacgatgacaacgattcagtgatccacagactcaagtgaacctttcatcacactaaagcttcagagtacccaggacatgcgatatttaaatcaactaactattgtgattaaaagcagattctcacaatcaccctctgtctcaatgcttgctgccgacatttttttcattaaattgttctgttttccagctgggcaagatggctcacacttgtaatcccagcactgtgggaggccgaaggtgggaggatcacttaagcccaagagttccagaccagcctgggcaacatggtgaggcttcaactctatattaaacaataataataataataatagtaaaaatctggccgggtgcggtggctcacacctgtaatcccagcactttgggaggctgtggcgtgtggatcacgaggtcaggagacggagaccatcctggctaacatggtgaaactccgtctctactaaaaaaatacaaaaaattagccgggtgtggtggcgggcgcctgtagtcccagctactagggaggctgaggcaggagaatggcgtgaacctgggaggcggagcttgcagtgagccaagatcacaccattgcactccagcctgggcgacagagcgagactccgtctcaaaaaaaaaaaaatagtaaaaatttaaaaagttctattttcctactgtaattctttattctttcttttctttttttttttttttgagacggagtctcgctctgtcgcccaggctggagtgcagtggcatgatctcggctcactgcaagctccgcctcccaggttcacgccattctcctgcctcagcctcccaagtagctgggactacaggcgcccgccagcacacccagctaatttttgtatttttagtagagatggggtttcactgtgttagccaggatggtctcgatctcctgaccttatgatccgcccgcctcagcctcccaaagtgctgggattacaggcgtgagccaccgcgcctggcctcctactgtaattcttatgaagaatagcttggtataacaacgtaatctttctttgataatcaagaaccttgcagctctcagggccatcctctgtagttcttaagccacagtatataccacaatacagaacaactagcatttggttatcacttcacccactgttggatccataggaccctgcaaggatctccgtcaccagccccacttccaggcacccaggcctgcctatttccctctcaatcccccactcccagggccctgggtaagggcttctcgtggctccttggaccagcgacagcagaagcattctcccagccaccatttctgtgacttccgaaccactgcacacatgccactttagaaagagaaatcactccacgtgagaatatgtacacaaatgttcacagcagctttatttttaatagtgccaaactagaaacaacccaaacctgtccttcaatgggtaaatggttaaactaactgctgtatacccataccatggaataccactcagcaactgctgaaacataccacaacttgggtggatctcaggggcaggatagtcaacgaaaaaagccaatctcaaaaagtcacatcctgtataactccatgcatataacattcctgaaaagacaaaagtatagagatgcagactagattagtacttgccagcagttatgaatggtggggaaaaggggctgctgtggctgtaagggggtgggacaaggagatatctgggatgatgacatagttttgaatcttgattgtggtagtggttataggaattttcacacgataaaaaatgacaatgaactctatacaccttgctccgatgcccaatgtcctggtttagacattttactacagttgtgtaaatatgtaaccgtgggagaaagctgggggaagggtactgggacctctctgtgccatttgtgcaacttcctgtgaatctataattatttcaaaatatggaaagaaaaaagagagatttgttgaaagtgtgcagtgatcacaccattctcccatttgaactccttcaacagtgactgactgcctggagaataagattcagttccctagcacagcacaggagatggcagtcctctggcccaatcttaggcaacatcaaaccacctgggatcagcggacacacccagctactgcacaccttcaggcctctgcctaagctgttccatctgcttgaaatgacttccctcccctttttgacctgctggtcaacattcaccctccttcaaaaatctagttcaagcacttgcttctcttacatgtttcctcctccagcctttcccttcaaaccatgctgggcatgcccccatttttgccaccctcccagtattcgctttagattgcattccgagtctacttacacttctactctgtaagggcagaaaatgtgtctgatttatttctcaatcctctactgattacacagtgggtgcccaaaaaatgtttgttaaagacaaagctaaatgggagaaaaaatgcggtagggcagctgggagcagtggttaagatcgggactttgacttcagactcccagtgggtctgctatttatctgggtgatgtgcagcaagcgattgcactcatctgcaacacggacgagcagagagcctcagggtacctctagataagaagtgcacagcccacttaggaaggcatcttgatgcaggaatgcaccctaaatctgacgaagcctcgtctagatccaattactaacttacagagattacagagaaacacattcaattacactgcagagatgcaatcaatcaaataccaactatggaaatgctaaggaacaactcgattgcttcaacaaataaactaccaagaaaacaaagaaataggagggggatctatggattaagagaaacttaaaagacgtatcatccaatcaacaacgtatggccttctcttgctctactttcaaactattaaggaaacctaaaattcatggggcagctggaaatttgaatattgactagttatttgatgatattaagcaattattactttttcaactttaaaagagtcagtacctttagagacctaccgaagtgtgaagtataactactgtacacctcctgagcaccctgaggttgtgcccgtatgttttacagatgagtgcaatcgcttctgcacatcacccagataagcagcagacccactgggagtctgactcaaagtcctgatcttacccactgctccgagctaccctaccacatttattctcccatttagctttgtctttaccaaacatttactgggcacccactgtgtaattagtatcccaaaaaataatgaatgaaatgacatgatatttaggatttgcttgaaaataattatgggtggtaagggtgcaagtggataccattagagatgaaacaagattggtcaggagttaataactgttaaagcaggacactattctgtttattttgtatatgtttgaaagttcccataataaaagttaaaataaaaagaatgatgttgaaactggttcatacaatcaagtacaaagtatcaggaattaattattctgaaggaaaattatgtaaaaatggcaccttcctaaccaagtgtgaggtgtaactactgtatgtatgtagaccaaaaatagttgccctattggcaaatcaatagtctcaagaagaaaaaaaatctggtctctgttttatcttatgcctcatgaaaacaactggtttactcgctattaactggtttgtctggtccttttctttatccagaaaattaagaatattttatcttagacacattcaagtatcccctctgttgtttatttacgggaccaaataaacagattttaatctgtgaacaaattaaagtcctggcaccctgaaaattaaattgccaggaaaatcaaagctgtcaaaagagaagtctatgcaaaaatagtattgtttttaactctgcaggatccttttgaagaaaaaaaaaagttaaatggaggaaaacattaaatagattggtggtcattcttccagaacaagttaaaagccaaaagagaatactcagagctgagggacccaggaaagaatccttatctgggaagtgatctgggttcgaactccactcaccagctgcttgctaagaaacagactacttagactcctgagcttccgtttccacagggctccagttacaatcaaatgagtatctgggctggcacctgggcaaacagggcctggctcccctggccttaggctacctttcctgctctcctcacagctcctccctcccacacagccagtcctggaggatgacgatcctgcaaccaagctgaatgaatctgtatttggcttggctcacagcattaaaaaaaaatttaattagctattgccaacatttaaaaatcagaacaaatgtggagtgctgccttcctttttagagacagggtcttgctctgtcacccaggctggagcacagtggtgtgatcatagctcactgcaggctccaaatcctgggctcatgggatccttccacctcagcctcccaagcagctaggactacaggtggatgccaccacacctagctaatttcttaaaattttttgtagagacagatctcgctacgttgcccaggctggtcttgaactcctggcctgaagtgatcctcccacatcagcctcccaaagtgtcttgaaattactggcgtgagccatggcacccagccaaattccaccttcttctagaaaactgctgggtaaggttcctgttctttagggtccccacgactctgtgtccttacacctggccctccagactgattctcaactccacagtggcctacggtccttccttggccctgctccttcacacctctgtgcctctccctgcctagcaaatttcttatcaccctcaaggccccccagcaccacctgtcacctcctccacatttccatggcatagcccctcccctatagcaagggttgtacagtcctggaactaagtgtctgcatgcctgccttctctactgggctcctgggctctctcgggaaagggaccccgttgctatctgccttgtgtccgtagggtctagcagaaagcatgacctagataatgcagaattcagtaaatgtctcttgtatgtgtggaagaaagctacagctaaactattataaaaatgtgagattttatatcacagcttgttccaacagttagcaattaaaggggtcaaggacaccaaaatgtttcacaaaatagaacaagcttccatctgcttacaagtttcacacgctaatcagaagtcactaaatgaacagataaagcagagacaacaggcaggctgggccatttctttgatcattcattcattcattgagctgatactactgaatacttcctgtgtgctttctaagcactggggataaagcagtggacaaatcagacagctacctgttttcacaaagttacatcctagtcggggagacagaaaataagcaggcaaataaatagaatagtttcaaaccagatgagagctaggaaggaaattttttaaataatgaaatagcatgactaagggaagaaagagggtggtcgaggagggcctcacccaaaacgagacatctgaccagaggaaggagcagaaagagctacttgtgccaagatcacggagacaactccaaagacggggaaacagcaaatgcaaaggtcctggggcaaatgcgggctggcatgttcaaggcgggcgagatgagtgggacggggcagcagtcttctgggggaggggcgcggtggtaagggattcgggctgggtcccctctggcactgctggacaccgagtgtgcaatgacaaggcaagagaggagtgcgcggggaggcgggaggctgggcgggtggggagggggttcctacaccactcacaccagcacgggccagcaccctgcccagtcttccacagatgcacaccggggtcctgcccaggcgtctgcatacattcacacagcctgacaacaaccctgtccagaagagacatttccccaccttcccgaaggcaaaaccgcggcagagcgagggtcagtgccttggccaaggtcgcggggacgcgaccccgggcccctgggcacccggcgcaggagtgcagctgtctgccccacctccgggagggatggcgcccgcagaccccacgggcaggtcggccgggccaggccggtgagcaggcccgcagcccggggctgctgacagccgggcggaagggggcgcctgcggcatcccccagcacaggggcgacggctgcggctgccagggccccgcagcccccggcccgccccgaagcccccggccgcgcggttccctcaccgcccctccccgcgggcccggcccgagcagccgccgccaggcctagcccgcccgccgggctcacctcgcctccccgccgccgcgccacggggagagggcgggcgggcggactggcggcgctgcgtgctagtcactcctggctccgcggccccggctccgccgccggcccgccccgctccgctccgccccgccgccgccgccgccgccgccgccgcagtgggtgtgaggggcgccggggcgctgcgacccttccggtcccgctcccttctccgccgctgccgccgccgc

SEQ ID NO: 229 - DNA, 14012 bp, Homo sapiens
tgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacccagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattctacaaagaaaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgagaatataacaaaatctgacctgttccttctgcctctgctgctaccagcctagccctggaatattgtgataatatgattgtgattgttcccagcacagtggccagaggggcccggtagaacctaaggcagatcacattgttctttggctggacacccttccctggctccccatttactcggagcaggagctgaaagtccctaaaaagcctggaattgtgataagagctcgtccccagttccctctccctttgcttatctgctacagtcacagaggcctcctcactgcactgccagcaaacccagttcatctcatctctacgcagtaagcttgtcctccagaacctggagagtgaacttctgcctctttacggtctttgttcaaaaaccaccttggcagagaagctgtccttgatagatcttacctgaccctacactcccaccccaaacacagattcctatcccctcccttggtatgtctctgtaccatttaccactgtctaatatgctcctattttcttatttatgcttgctgtctctcccccaagaaaacataagcttcaccagggcaagcatgctttgcttgttttgtgcatggctgaaaaatacctagcaccatgcctgatacatagaagacactcagtcaggttaggcatggtggctcatgcctgtaatcccaccattttgggaggctgaggcagacggatcacctgaggtcaggaaatcgagaccagcctggccaacatggtgaaaccccacctctactaaaaatagaaaaattagctgggcatggtggtgcgctcctgtaatcccagctactcgggaggctgaggtaggagaatcacttgaacccgggaggcagaggttgcagtgacccaagattgcaccgctgcactccagcctgggagacagaccgagactccatctcaaaaaaaaaaaaaaaaaggcactcagtcaatctctgctgaataaatgataaatgcataaacgaattaatgagctgggatgctaaaaaggccaggcaacatttacacatctcaccagaaaaaactgcactggtcaccaaccccagccagccaatgagaaagactggaggccaggaaccacaccccatccaacaatccccctcagttcctgactcggagctgctcctgtgagttgagtaaataccctgcaataggcacagtcaaagacgccgtatggtccccagtctctggtgtagcacattcttctgtgttaaatggaataaataaaatacactgcggcggcagctttctgctttcacgtggtagaggctcgcctgggctggcccttagcctttggctagagcagtctcctgggcctcggctgccccactcatttccttggccagcagtaggcatgtttcttccataactgaccagacaggaactattttccggtttgtggctacatgtaccatctccgtcacaacgactcagctgttgttacaggatgaaataagtaagtaaataagcatgggccaggcgtggtggctcacgcctgtaatcccagcactgtgggaggcccgggcaggtggatcacctgaggtcaggagttcgagaccaacctgaccaacatggtgaaaccccgtctctactaaaaatgcaaaaattagccgggcatagtggcacacacctgtaatcccagctactcaagaggccacggcaggagaatcacctgaacccgggaggcggaggctgcagtgttccgagatggcaccactgcactccagcctgggcaacaagagagaaactctgtcttggaaaaaataaaaaataaaaaaaaaaaataagcatggctgtgtttcagtaaacctttaaaaaaaattaggtggtgggctggctttgctgtaggctgaagtttgctgacccctgccttcagtaattcctccctgcaccccttcagggtccaaagcctccaatcttgcaatataaaaagatctaaccttagtgactgaatgattcactaaatacacaattatatagacaagttccagtttatatagaaggtaatgaaattaaaataagaatctgtatcaactcaaaatctgtgcccttggaggtacacctctggcctcaggctggtacgctcaatactgcagccccttccttcacccttcttcactgcagaactcagaaagcatgacgggattccacatctccccaaacccacaagacctatagttctggcctacaccatatagaaagcagctttccctttctgaaacgcagaaccactaaggggaaggtttaggctcccctcccctcccttgttcctccccctccctgccaccgggactgctgaagccagctcagccatcttgtgaccatgaggaagaaggcgacgtgctgagaatggtggagccgcctccctgggatcatcgccccagtgccagaccagcccaggtctcacctgcctccagacctcctagcaggggagatgagctcctaggagataaaccatggtgaaccggggtttctgttatctgtagtcaaagcccttgtacatcttgttaatcattaaattttaaagagagaaattattttgccaggggaaaatagcacagttcatttcagaataaagcttcaaagaaaataattctttctgaattgcgaggagaacagacaatgaaaataaatttcttgaaaaactgaaggctcaagttcaagttagcctggaagatctaactatggtcaatgatcaagaatacactgtaattaatctattctgtttactttgtctatgttcaaaaatttctatagttaaagaaaaacaaaacaagagacaataaagaagattcagtgagaggaagataaagggccatcagcaaatgacatcttccacgctggaggtggttaatctcagtgtctatctacatgtttggtttggttgttttaaaacaaaaatctgtacttatccttactatcaagagaggactgaatatcactcatcggttcagcatttactaagcaccagctacgtgtctggcacttgtcagagagtcctccctgctcagcctcaattcagcaggctgagttgttccgctcctgcagtgtggcacggaggccagcaggaggcgcggtagcggggcttcccgggacgccgccagaaagaaaggagtgggtaggtcctgatgggaatgaagctagagaaaaggaggaaatgtccgctagaagatggcacgccatatctggagtctgagctttaagaccttgatcgagcctgagggctgcagcttcagacttgccctgtaggtggcagggcggatgccaggcgcccagggacacgaggccacccaatggatgtcaagcaggaggggcagggacagaaaggccccacggctgcagacgcgggaggccccgagccggagacgctcgtgtgaacacaggcgctgctcctgtcacggccccttactcgccttgctgactttaaacagtctctcctcggtgttctccttgtcaaactgttcatcccagtttcctctgaaatagacagcattcaccagaaccagccttgtcaatggatccactgagcccggagagagcaactccgcaattttacctgagcggaagaattcaagaccgcattagataggggcggctgcggatccccgacacatcaggaatcggctggggccttctccttcagcagtcaagtgcacggatagagagttccactgtcccccaaatataaagggatacgtgtccttaaagcaaaacaacaaaatcttctggtacgaaaaacatcatcaattgaataaaacacacaaagtgaacaaatatgcgttaattatgcaggatgagttcctaacacatgagataagaagcaatcatgggtgcctatgacttaaagacaagaacttaaaggattatcaaaaaggtgggcagtcagaagatgttctttacaagcttaaagaacagttaggccagacacagtggctcacacctataattccagcagtttgggaggctgaggtgtgaggatcacttgaggccaggagtttgagaccaacctggacaacatagtgaggccttgtctcttaaaaaaaaaatttattaaaattagctgggcatggtggtgctacctgtagtcccaattacttgggagactgaagcaggaggaccgcttgagcacaagaattgatgctgtaatcccagcactttgggaggccaaggcgggtggatcacgaggtcaagagattgagatcatcctggccaacatggtgaaaacctgtctctactaaaaaatacaaaaattagcagggcatggtggcacgtgcctgtgatcccaactacttgggaggttgagataggagaatcacttgaacctgggaggcagaggttgcaatgagccaagattgcaccattgcactccagcctgggcaataagagcaaaactccatctcaaagaaaaaaaaagaaaattgaggctgcagtgaattgtgattgtgtcactgcattccagcctaggtgacagagggagaccttgtctcaaaaaaaaaaaaaaaaaaagtttaaattaagaaccacagatagaccagggcgtgacccagtgtcccacagcaatgcatggcaactgtagactgtgctacccaagagggaggcagcttgagatccacactgcgaattttttatgttacttgtgaaaggaaaaactatattaacattaacacactaaccccctcctcaaaattaaaacgtggattgatccagaagaggtataccaaacactgaaaggcatcacgggtacaccaaggaaacagggagaaatcagagagaacagaacacattgagcatttccaaaatgtcaaataatggcaactgatttcagaagcagattttttaagtttgcagttattcagagaaaaaaaaatcattcctgtttacaattgacagtcttgtgaaggaactgacaataaaatggattaagaggttattacaaaagtagaataacaatacattttcaccttctgtcttttcagctacccaggtgtttatgtgttttctggacttctctacggcgctgataaagtcaagctcctccatctctgcttggtagaatttttggcaggaatctctaaaagactaggatagacagagtgacataactgcctggctacaaaaatgatgaacaccaacggcctacttcttcattgcaccaagtcagaaaatctataattttatgattgacatacataatttacaaataaatatgaggacttaacctaaactacaacttcctagctttagctatatttaatcctagcttaaaaactaagtcaaggtcaggtactgtggcttacacttgtaatcccagcactttggggggccgaggcgggtggatcgtgtgagctcaggagttcgagaccagcctggccaacatggcgaaagcccgtctctactaaaaatacaaaaattagccatgtatggtggcatgcacctgtaatcccagctacttgggaggctgaggcaggagaatcacttgaacccagaaggcggaggttgcagtaagccgagatcaggccaccacactccagcctgggcgacagagcgagattctgtctcaaaaaaaaaaaaacaaaaaaaaaaaagcaaaaaacactaagttgaatcagtctctgaatatcaaacgaacttcaccaactgctggatcctttaagggagcagccatgcatcaaggagctgcctgacaagatgctgacaagacacttcaaaagcgtgaagtagatccaccttattgaaatgcagagaatttaaaacatattggcaggtgaaaagaaattacaaaagcctatgtatggcataatggcatttagagccacacgcttcctgctgggccccagcccccactacctggccacctttatttctttagtgaataagagcaagtatgacttactgagaggaaatcacaagacttttccccaaagagcctgttggccatcctaagcaagtactgcgtgccagtcttgttcacttcggtgagaagagactggaagccctggtggatgtctccaccaccgccacttttattgaaagaaagtatctgaaatcaaaaacagaatgaaaacaaatcattcctgtatgctctgacttcaggaaatggggcaaccccaaactcagcctaacaaccatccagacccttattactgcttaaaagatctatccgaggctgggcgcagcagctcacgcctataatcccagcactttgggaggccaaggcgggaggatcacctgaggtcaggagttcgagatcagcctggccaacatggcaaaaccccatctctactaaacacacaaaaatgagctgggcctggtggtgcgtacctgtaacccagctactcgggaagctgaggaaagagaatcgcttgaacccgggaggcggaggttgcagtgagctgagatcgtgccactgcactctagcctggcgacagagtgagactccgtctcaaaaaaaaaaaaagatccatctgattaaaggccagaagggtcttgaaagcccctccctgtaccctgtctgtgctggcatgagctgcaacgccctccacaaacccaggctcctgatgctcagtacttggagtctggtggcaaacaagggtgccaaccagacctcctgtctatacaaacacaggccgcccctgacatcagaaggggcagactccctcctgcccgtggctctggaatgcccgtgtcactggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtagagagagttgcttgaagaactgaggcctctagccgggcgtggtggctcacacctgcaatcccagcactttgggaggccgaggcgagtgcatcacctgaggtcaggaatttgagaccagcctgaccaacgtggagaaaccccatctctactaaaaatacaaaattagcctggcgtggtggtgcatgcctgtaatcccagatactcgggaggctgaggcaggagaatcacttgaacccgggaggcggaggttgcagtgagccgacatcgcgccattgtgctccagcctgggcaacaagagcaaaactctgtctcaaaaaaaaaaaaaaatcgaggtttcaggtgtgagagaggccttcttgaaccttccgggccaggtgtccactgaaacagctgcatgagtgacctgcactgcttcctgggagcagtcctgcctgctcaggccacggaatctgagaaataatcaatcattgttatttccagccactaagtttgggatggtttgttttgtggcaacagctgacacatgcagccatccagaagtggaattctgccatgaccaaaacctaaaacatgtggacttggccttggacccaggcagctggcagaggctggacggacaggacgaaatgactcctgggggctggagaaagggggctgtgtgtgtaccagctgaagaagtggaaagaaggtcaccctcagtgacagggaggatggagtgcctcccccgggaactcctgcatctggctaaggggtccaggaggaagctggcttctttttgctgcctagggtaacacatgggaagagaaagatgaaggaactgttccattttcaagcagaatttaaaggaactatttccaatccaggatgtactgggtggagaataaaaatgtttcttcttcccagcctttccagctggcaaaagattctaaaagagatggcctcagggcaaagatcaaatcccagacactggcctcaagggtgaggtccaaatccactttgttaaaccttagaagattcagacagcatcttatagaccatctggcaggctctcccatggcaccctgactcccaacccaacaaagagcactcaggatggcggtgggggtgcttttgtccagggaagcagaattttaagttgatagaaattccacagtggttttcaggcacttgtaacagcttggactaaaagagagagacggctcaaagtgcagggaggcctctgggtgcccacgttctacaggtgggaggtaggctgggagcgcagcaagcacgggccatttcttacagaacaggaaaggagctgccaagagcgacaccaggacacagagggcagagcacagccagggcagcaacggacaagggacaattctgggaagctgcagtggaggctcatcaaggaacaccctgcacccagggctgagaggtgaacaatacatgcctggctgggcttgggaattgccactgctccgtgacggccacgtgcctcccacgcctactgtgatgggctgcatgtgtcccctcaaatttacacactgaagtcccaactccagtgtctcaggatggaactgcatttgcagagagggcctttacaggggtgattaaggtaacataaggccattaggttgggctttaatccaataggactcatgtccttataaaaagaggagatgaggacacagacacacacagagagatgaccatgtgaggacacagggagaaaacagtgtctacaagccgaggagaaaggctgcaggagaaaccaaccctgcctacacctggatctcaggctcccagggaaccaccaggtccagagggcagaccacagcagtcacgggtggccccgaccagctacatctgtggtgtgcgcaccctctctcaacccctctcaggcgcggagatgcctctgcctttggcagtggggccttggcaagcaggacacaggcggggacgtgatgggtacttgtttcaagcctgtcttctgcgagcacttcctctcagaacccagccgccaggcctacggaagcccaggcaacgctgctgaaggaagcatgtggaaggccccagcggagaaggccacggagaagacgcccagcgccccgctgagcccccgctgacgcagcccacaagggacccacccagtgccaagtggtgcagaagcaccactcaatccacccagattcaacaaccaggaaagctgctaagctgggagagctggttacacaacaacaaataaccagaacgctactgaaaacatgtttagctgacaaatgccattctaagaaggctttacgcgtaaatgagaaaataaagactcctaacaaccaacaagcagatgacagtacccaaagatcatcacaggactcaacctgaaccttgtgactttacaaccatctacaaactcacgaacaagctaagccatgtgatgatgaaatcattcattcctctgaatcgggcgccccctctccaccccagggggtcagtcagggtgttgtccccagggtgctccagcatgggtggcatgcccttccctgtaaactcgccacccacaccctgcaatactgcacagtcatccgtctcgagcgatccctttgggatttggaataaggaggaccagctaacttgacagttaatagcaccatggctgccctgaagctgtacctgggccatctgtgcagcggtgtttccctttgcccccatgtagaccatggccagggcacaggacatgctcatgggtgagaaaaacacattcttcgagttgtctttacccagcgttttcaaaaggtttaaggcaaaggtgccatttgcttctgcgagaacatccatgatggcagacctggaacaagatttaaaatcagtatcacttaagcacagcttccacgcgactgcatctcacgcgccttaccgacagtcaccgccgatgctgtggttcagtgggcaagcagaaacacacacagaactctggctgtttctttttaggaccctccacattattttgtgtgtttctaatgttaagtgtggaaaatgaaagagttctatgtgaaacgccgccctgttttgtgaggactcctccctgcacgcctgcccgcacgtggagaaagtgggaaggaggcaccctttcctggagtctcttccttggggtggaattacagaaggggcactggcttttgcttctatgtttgtattctttggtgtgttttgcgggcttaaatgtactgttttaatttgaaaaatattcaaaatgatacattcactgacagttacacaagaaaagatggccaaatgtttttataatgagagagagaatcccatttctgggtagcaagagccttaaaaaaggatcaatcaagccacatacaaagatgcgtgaaagcctttcaaatgcctcctgacccttggatctccttctaggaaatccctgcaggtggcaaagccccaattttggaccacgcttggggacatcctgctgcaacaagccaggccttcctgcgcctgaactcacagcacactcaggacaccaccttgcctcatgggctgtgggtgcatgcccatctccaccttcacagacaggctcaggggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatcaatgccccactgcactacagggaaggtgaagttgacggaagtgaagctaagaagtagctgggcttgaaacgcagggcggatgcgctttctgagctgctgctcaagaagaagaatctgcagaatcaggtgagaggacaaggggcagctaagggccccacaggcagtcaggctgggaaggaggggatgcaggaatgcagggatgcggggcctgcctgctctgacacagttctcagatgtttaccaaatgaatatgtcccagtcagagaatgccagcattctaagacagtcccagtgactcacttgagcagtgagtgggaacccacggaacaaggaaggggagaagctggagcagacatttcctggagcagatgggagagggaaggaggtgcctactggaggccctgtgaggagatgctgaattaagcggctctccactgtgcatgcctttacatttggagctggggttggctgagcaagtgctccaaagatacctgggtcataatccctgggacctgtgaatgccccttacatggcaaaagggactgtgcagcacgattagattcaggctcttgagatgggagattatcctggattgttccagttgaccctaaatgtaatcacaggtatccttctaagagggagggagggggagatctcacgggaaaaagcaatgcaaagaataaagcaaaatgccactccactggccttgaagatgaagggcctcaagccaagaaacgcaaggaccacagctgcagtagctggaaaggcaaggaggatcctctggaggagcctggccctgcggaacccatttccaacctccaacctcagaactctgagaaaataaacatgtgcagtttagccacgaatccatggtcatttgttacagcagccacgggaaaccaagacaataactcatacacctgataaagcttgtttgctgtgcttgtttaaatattttgttttcaaactcttctttattcattacacagaatacttggggcactgggcactcctggcttgccaagcctttccaaacatattttaagattactaatttctaataaaaggacaatagaaagtacatattactaaaattcttctgaatataagggagtctttgatgatacataaataaatccaggattccgcagagccctgggaacaccagtataaacaaaagtagccattacacggaactgaagcaaaattgggcctatttttggttctttggattctagatcacaagaactgcccgcttatcaacttgaagagaaacaattggtaaaacagggaaacttctaggttaagaataagaaaagaggagatgccccaaagcaagaagcacagcctgtgaagtccgtgtctcaggactcaaagccagcagacaccctgacacgtggggttttccctggcctggggacatggacttctgtctttgtccccaagagggctcagcccacgtggagaggctgccaggtgagatggctcctccataaaccaaaaaaaaaagacagaggttaagtaccatgtcagctggccaggggaaggtcccacatgctcccccaaccccatcctagactattctaccgtcagcacacgttttcccctcaaatgctgaaggactcttacgcttttttttttgtagagacaaggttcttgccaccttgcccaggctgctctccaacgcctggcctcaagtgatcttcctgcctcagcctcccaaggtgctgagattacagccatgcaccacgcccagcctaaaggacttttaattcaaatggaaatgtccacctaagaaaggctaataataaaacactccgtctccggtaatatcccggagaatctgtttcaggcgctgatctttatatcagtaacttcaacaaagcaaagccacctttgtctgaag

SEQ ID NO: 230 - DNA, 22890 bp, Homo sapiens
tgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacccagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattctacaaagaaaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgagaatataacaaaatctgacctgttccttctgcctctgctgctaccagcctagccctggaatattgtgataatatgattgtgattgttcccagcacagtggccagaggggcccggtagaacctaaggcagatcacattgttctttggctggacacccttccctggctccccatttactcggagcaggagctgaaagtccctaaaaagcctggaattgtgataagagctcgtccccagttccctctccctttgcttatctgctacagtcacagaggcctcctcactgcactgccagcaaacccagttcatctcatctctacgcagtaagcttgtcctccagaacctggagagtgaacttctgcctctttacggtctttgttcaaaaaccaccttggcagagaagctgtccttgatagatcttacctgaccctacactcccaccccaaacacagattcctatcccctcccttggtatgtctctgtaccatttaccactgtctaatatgctcctattttcttatttatgcttgctgtctctcccccaagaaaacataagcttcaccagggcaagcatgctttgcttgttttgtgcatggctgaaaaatacctagcaccatgcctgatacatagaagacactcagtcaggttaggcatggtggctcatgcctgtaatcccaccattttgggaggctgaggcagacggatcacctgaggtcaggaaatcgagaccagcctggccaacatggtgaaaccccacctctactaaaaatagaaaaattagctgggcatggtggtgcgctcctgtaatcccagctactcgggaggctgaggtaggagaatcacttgaacccgggaggcagaggttgcagtgacccaagattgcaccgctgcactccagcctgggagacagaccgagactccatctcaaaaaaaaaaaaaaaaaggcactcagtcaatctctgctgaataaatgataaatgcataaacgaattaatgagctgggatgctaaaaaggccaggcaacatttacacatctcaccagaaaaaactgcactggtcaccaaccccagccagccaatgagaaagactggaggccaggaaccacaccccatccaacaatccccctcagttcctgactcggagctgctcctgtgagttgagtaaataccctgcaataggcacagtcaaagacgccgtatggtccccagtctctggtgtagcacattcttctgtgttaaatggaataaataaaatacactgcggcggcagctttctgctttcacgtggtagaggctcgcctgggctggcccttagcctttggctagagcagtctcctgggcctcggctgccccactcatttccttggccagcagtaggcatgtttcttccataactgaccagacaggaactattttccggtttgtggctacatgtaccatctccgtcacaacgactcagctgttgttacaggatgaaataagtaagtaaataagcatgggccaggcgtggtggctcacgcctgtaatcccagcactgtgggaggcccgggcaggtggatcacctgaggtcaggagttcgagaccaacctgaccaacatggtgaaaccccgtctctactaaaaatgcaaaaattagccgggcatagtggcacacacctgtaatcccagctactcaagaggccacggcaggagaatcacctgaacccgggaggcggaggctgcagtgttccgagatggcaccactgcactccagcctgggcaacaagagagaaactctgtcttggaaaaaataaaaaataaaaaaaaaaaataagcatggctgtgtttcagtaaacctttaaaaaaaattaggtggtgggctggctttgctgtaggctgaagtttgctgacccctgccttcagtaattcctccctgcaccccttcagggtccaaagcctccaatcttgcaatataaaaagatctaaccttagtgactgaatgattcactaaatacacaattatatagacaagttccagtttatatagaaggtaatgaaattaaaataagaatctgtatcaactcaaaatctgtgcccttggaggtacacctctggcctcaggctggtacgctcaatactgcagccccttccttcacccttcttcactgcagaactcagaaagcatgacgggattccacatctccccaaacccacaagacctatagttctggcctacaccatatagaaagcagctttccctttctgaaacgcagaaccactaaggggaaggtttaggctcccctcccctcccttgttcctccccctccctgccaccgggactgctgaagccagctcagccatcttgtgaccatgaggaagaaggcgacgtgctgagaatggtggagccgcctccctgggatcatcgccccagtgccagaccagcccaggtctcacctgcctccagacctcctagcaggggagatgagctcctaggagataaaccatggtgaaccggggtttctgttatctgtagtcaaagcccttgtacatcttgttaatcattaaattttaaagagagaaattattttgccaggggaaaatagcacagttcatttcagaataaagcttcaaagaaaataattctttctgaattgcgaggagaacagacaatgaaaataaatttcttgaaaaactgaaggctcaagttcaagttagcctggaagatctaactatggtcaatgatcaagaatacactgtaattaatctattctgtttactttgtctatgttcaaaaatttctatagttaaagaaaaacaaaacaagagacaataaagaagattcagtgagaggaagataaagggccatcagcaaatgacatcttccacgctggaggtggttaatctcagtgtctatctacatgtttggtttggttgttttaaaacaaaaatctgtacttatccttactatcaagagaggactgaatatcactcatcggttcagcatttactaagcaccagctacgtgtctggcacttgtcagagagtcctccctgctcagcctcaattcagcaggctgagttgttccgctcctgcagtgtggcacggaggccagcaggaggcgcggtagcggggcttcccgggacgccgccagaaagaaaggagtgggtaggtcctgatgggaatgaagctagagaaaaggaggaaatgtccgctagaagatggcacgccatatctggagtctgagctttaagaccttgatcgagcctgagggctgcagcttcagacttgccctgtaggtggcagggcggatgccaggcgcccagggacacgaggccacccaatggatgtcaagcaggaggggcagggacagaaaggccccacggctgcagacgcgggaggccccgagccggagacgctcgtgtgaacacaggcgctgctcctgtcacggccccttactcgccttgctgactttaaacagtctctcctcggtgttctccttgtcaaactgttcatcccagtttcctctgaaatagacagcattcaccagaaccagccttgtcaatggatccactgagcccggagagagcaactccgcaattttacctgagcggaagaattcaagaccgcattagataggggcggctgcggatccccgacacatcaggaatcggctggggccttctccttcagcagtcaagtgcacggatagagagttccactgtcccccaaatataaagggatacgtgtccttaaagcaaaacaacaaaatcttctggtacgaaaaacatcatcaattgaataaaacacacaaagtgaacaaatatgcgttaattatgcaggatgagttcctaacacatgagataagaagcaatcatgggtgcctatgacttaaagacaagaacttaaaggattatcaaaaaggtgggcagtcagaagatgttctttacaagcttaaagaacagttaggccagacacagtggctcacacctataattccagcagtttgggaggctgaggtgtgaggatcacttgaggccaggagtttgagaccaacctggacaacatagtgaggccttgtctcttaaaaaaaaaatttattaaaattagctgggcatggtggtgctacctgtagtcccaattacttgggagactgaagcaggaggaccgcttgagcacaagaattgatgctgtaatcccagcactttgggaggccaaggcgggtggatcacgaggtcaagagattgagatcatcctggccaacatggtgaaaacctgtctctactaaaaaatacaaaaattagcagggcatggtggcacgtgcctgtgatcccaactacttgggaggttgagataggagaatcacttgaacctgggaggcagaggttgcaatgagccaagattgcaccattgcactccagcctgggcaataagagcaaaactccatctcaaagaaaaaaaaagaaaattgaggctgcagtgaattgtgattgtgtcactgcattccagcctaggtgacagagggagaccttgtctcaaaaaaaaaaaaaaaaaaagtttaaattaagaaccacagatagaccagggcgtgacccagtgtcccacagcaatgcatggcaactgtagactgtgctacccaagagggaggcagcttgagatccacactgcgaattttttatgttacttgtgaaaggaaaaactatattaacattaacacactaaccccctcctcaaaattaaaacgtggattgatccagaagaggtataccaaacactgaaaggcatcacgggtacaccaaggaaacagggagaaatcagagagaacagaacacattgagcatttccaaaatgtcaaataatggcaactgatttcagaagcagattttttaagtttgcagttattcagagaaaaaaaaatcattcctgtttacaattgacagtcttgtgaaggaactgacaataaaatggattaagaggttattacaaaagtagaataacaatacattttcaccttctgtcttttcagctacccaggtgtttatgtgttttctggacttctctacggcgctgataaagtcaagctcctccatctctgcttggtagaatttttggcaggaatctctaaaagactaggatagacagagtgacataactgcctggctacaaaaatgatgaacaccaacggcctacttcttcattgcaccaagtcagaaaatctataattttatgattgacatacataatttacaaataaatatgaggacttaacctaaactacaacttcctagctttagctatatttaatcctagcttaaaaactaagtcaaggtcaggtactgtggcttacacttgtaatcccagcactttggggggccgaggcgggtggatcgtgtgagctcaggagttcgagaccagcctggccaacatggcgaaagcccgtctctactaaaaatacaaaaattagccatgtatggtggcatgcacctgtaatcccagctacttgggaggctgaggcaggagaatcacttgaacccagaaggcggaggttgcagtaagccgagatcaggccaccacactccagcctgggcgacagagcgagattctgtctcaaaaaaaaaaaaacaaaaaaaaaaaagcaaaaaacactaagttgaatcagtctctgaatatcaaacgaacttcaccaactgctggatcctttaagggagcagccatgcatcaaggagctgcctgacaagatgctgacaagacacttcaaaagcgtgaagtagatccaccttattgaaatgcagagaatttaaaacatattggcaggtgaaaagaaattacaaaagcctatgtatggcataatggcatttagagccacacgcttcctgctgggccccagcccccactacctggccacctttatttctttagtgaataagagcaagtatgacttactgagaggaaatcacaagacttttccccaaagagcctgttggccatcctaagcaagtactgcgtgccagtcttgttcacttcggtgagaagagactggaagccctggtggatgtctccaccaccgccacttttattgaaagaaagtatctgaaatcaaaaacagaatgaaaacaaatcattcctgtatgctctgacttcaggaaatggggcaaccccaaactcagcctaacaaccatccagacccttattactgcttaaaagatctatccgaggctgggcgcagcagctcacgcctataatcccagcactttgggaggccaaggcgggaggatcacctgaggtcaggagttcgagatcagcctggccaacatggcaaaaccccatctctactaaacacacaaaaatgagctgggcctggtggtgcgtacctgtaacccagctactcgggaagctgaggaaagagaatcgcttgaacccgggaggcggaggttgcagtgagctgagatcgtgccactgcactctagcctggcgacagagtgagactccgtctcaaaaaaaaaaaaagatccatctgattaaaggccagaagggtcttgaaagcccctccctgtaccctgtctgtgctggcatgagctgcaacgccctccacaaacccaggctcctgatgctcagtacttggagtctggtggcaaacaagggtgccaaccagacctcctgtctatacaaacacaggccgcccctgacatcagaaggggcagactccctcctgcccgtggctctggaatgcccgtgtcactggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtagagagagttgcttgaagaactgaggcctctagccgggcgtggtggctcacacctgcaatcccagcactttgggaggccgaggcgagtgcatcacctgaggtcaggaatttgagaccagcctgaccaacgtggagaaaccccatctctactaaaaatacaaaattagcctggcgtggtggtgcatgcctgtaatcccagatactcgggaggctgaggcaggagaatcacttgaacccgggaggcggaggttgcagtgagccgacatcgcgccattgtgctccagcctgggcaacaagagcaaaactctgtctcaaaaaaaaaaaaaaatcgaggtttcaggtgtgagagaggccttcttgaaccttccgggccaggtgtccactgaaacagctgcatgagtgacctgcactgcttcctgggagcagtcctgcctgctcaggccacggaatctgagaaataatcaatcattgttatttccagccactaagtttgggatggtttgttttgtggcaacagctgacacatgcagccatccagaagtggaattctgccatgaccaaaacctaaaacatgtggacttggccttggacccaggcagctggcagaggctggacggacaggacgaaatgactcctgggggctggagaaagggggctgtgtgtgtaccagctgaagaagtggaaagaaggtcaccctcagtgacagggaggatggagtgcctcccccgggaactcctgcatctggctaaggggtccaggaggaagctggcttctttttgctgcctagggtaacacatgggaagagaaagatgaaggaactgttccattttcaagcagaatttaaaggaactatttccaatccaggatgtactgggtggagaataaaaatgtttcttcttcccagcctttccagctggcaaaagattctaaaagagatggcctcagggcaaagatcaaatcccagacactggcctcaagggtgaggtccaaatccactttgttaaaccttagaagattcagacagcatcttatagaccatctggcaggctctcccatggcaccctgactcccaacccaacaaagagcactcaggatggcggtgggggtgcttttgtccagggaagcagaattttaagttgatagaaattccacagtggttttcaggcacttgtaacagcttggactaaaagagagagacggctcaaagtgcagggaggcctctgggtgcccacgttctacaggtgggaggtaggctgggagcgcagcaagcacgggccatttcttacagaacaggaaaggagctgccaagagcgacaccaggacacagagggcagagcacagccagggcagcaacggacaagggacaattctgggaagctgcagtggaggctcatcaaggaacaccctgcacccagggctgagaggtgaacaatacatgcctggctgggcttgggaattgccactgctccgtgacggccacgtgcctcccacgcctactgtgatgggctgcatgtgtcccctcaaatttacacactgaagtcccaactccagtgtctcaggatggaactgcatttgcagagagggcctttacaggggtgattaaggtaacataaggccattaggttgggctttaatccaataggactcatgtccttataaaaagaggagatgaggacacagacacacacagagagatgaccatgtgaggacacagggagaaaacagtgtctacaagccgaggagaaaggctgcaggagaaaccaaccctgcctacacctggatctcaggctcccagggaaccaccaggtccagagggcagaccacagcagtcacgggtggccccgaccagctacatctgtggtgtgcgcaccctctctcaacccctctcaggcgcggagatgcctctgcctttggcagtggggccttggcaagcaggacacaggcggggacgtgatgggtacttgtttcaagcctgtcttctgcgagcacttcctctcagaacccagccgccaggcctacggaagcccaggcaacgctgctgaaggaagcatgtggaaggccccagcggagaaggccacggagaagacgcccagcgccccgctgagcccccgctgacgcagcccacaagggacccacccagtgccaagtggtgcagaagcaccactcaatccacccagattcaacaaccaggaaagctgctaagctgggagagctggttacacaacaacaaataaccagaacgctactgaaaacatgtttagctgacaaatgccattctaagaaggctttacgcgtaaatgagaaaataaagactcctaacaaccaacaagcagatgacagtacccaaagatcatcacaggactcaacctgaaccttgtgactttacaaccatctacaaactcacgaacaagctaagccatgtgatgatgaaatcattcattcctctgaatcgggcgccccctctccaccccagggggtcagtcagggtgttgtccccagggtgctccagcatgggtggcatgcccttccctgtaaactcgccacccacaccctgcaatactgcacagtcatccgtctcgagcgatccctttgggatttggaataaggaggaccagctaacttgacagttaatagcaccatggctgccctgaagctgtacctgggccatctgtgcagcggtgtttccctttgcccccatgtagaccatggccagggcacaggacatgctcatgggtgagaaaaacacattcttcgagttgtctttacccagcgttttcaaaaggtttaaggcaaaggtgccatttgcttctgcgagaacatccatgatggcagacctggaacaagatttaaaatcagtatcacttaagcacagcttccacgcgactgcatctcacgcgccttaccgacagtcaccgccgatgctgtggttcagtgggcaagcagaaacacacacagaactctggctgtttctttttaggaccctccacattattttgtgtgtttctaatgttaagtgtggaaaatgaaagagttctatgtgaaacgccgccctgttttgtgaggactcctccctgcacgcctgcccgcacgtggagaaagtgggaaggaggcaccctttcctggagtctcttccttggggtggaattacagaaggggcactggcttttgcttctatgtttgtattctttggtgtgttttgcgggcttaaatgtactgttttaatttgaaaaatattcaaaatgatacattcactgacagttacacaagaaaagatggccaaatgtttttataatgagagagagaatcccatttctgggtagcaagagccttaaaaaaggatcaatcaagccacatacaaagatgcgtgaaagcctttcaaatgcctcctgacccttggatctccttctaggaaatccctgcaggtggcaaagccccaattttggaccacgcttggggacatcctgctgcaacaagccaggccttcctgcgcctgaactcacagcacactcaggacaccaccttgcctcatgggctgtgggtgcatgcccatctccaccttcacagacaggctcaggggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatcaatgccccactgcactacagggaaggtgaagttgacggaagtgaagctaagaagtagctgggcttgaaacgcagggcggatgcgctttctgagctgctgctcaagaagaagaatctgcagaatcaggtgagaggacaaggggcagctaagggccccacaggcagtcaggctgggaaggaggggatgcaggaatgcagggatgcggggcctgcctgctctgacacagttctcagatgtttaccaaatgaatatgtcccagtcagagaatgccagcattctaagacagtcccagtgactcacttgagcagtgagtgggaacccacggaacaaggaaggggagaagctggagcagacatttcctggagcagatgggagagggaaggaggtgcctactggaggccctgtgaggagatgctgaattaagcggctctccactgtgcatgcctttacatttggagctggggttggctgagcaagtgctccaaagatacctgggtcataatccctgggacctgtgaatgccccttacatggcaaaagggactgtgcagcacgattagattcaggctcttgagatgggagattatcctggattgttccagttgaccctaaatgtaatcacaggtatccttctaagagggagggagggggagatctcacgggaaaaagcaatgcaaagaataaagcaaaatgccactccactggccttgaagatgaagggcctcaagccaagaaacgcaaggaccacagctgcagtagctggaaaggcaaggaggatcctctggaggagcctggccctgcggaacccatttccaacctccaacctcagaactctgagaaaataaacatgtgcagtttagccacgaatccatggtcatttgttacagcagccacgggaaaccaagacaataactcatacacctgataaagcttgtttgctgtgcttgtttaaatattttgttttcaaactcttctttattcattacacagaatacttggggcactgggcactcctggcttgccaagcctttccaaacatattttaagattactaatttctaataaaaggacaatagaaagtacatattactaaaattcttctgaatataagggagtctttgatgatacataaataaatccaggattccgcagagccctgggaacaccagtataaacaaaagtagccattacacggaactgaagcaaaattgggcctatttttggttctttggattctagatcacaagaactgcccgcttatcaacttgaagagaaacaattggtaaaacagggaaacttctaggttaagaataagaaaagaggagatgccccaaagcaagaagcacagcctgtgaagtccgtgtctcaggactcaaagccagcagacaccctgacacgtggggttttccctggcctggggacatggacttctgtctttgtccccaagagggctcagcccacgtggagaggctgccaggtgagatggctcctccataaaccaaaaaaaaaagacagaggttaagtaccatgtcagctggccaggggaaggtcccacatgctcccccaaccccatcctagactattctaccgtcagcacacgttttcccctcaaatgctgaaggactcttacgcttttttttttgtagagacaaggttcttgccaccttgcccaggctgctctccaacgcctggcctcaagtgatcttcctgcctcagcctcccaaggtgctgagattacagccatgcaccacgcccagcctaaaggacttttaattcaaatggaaatgtccacctaagaaaggctaataataaaacactccgtctccggtaatatcccggagaatctgtttcaggcgctgatctttatatcagtaacttcaacaaagcaaagccacctttgtctgaagacacgcccactggggaggtgcctgtctggccagcccaggttacaccatctggggcagaggagaagtcggtgcacatgagtttcactgtgtcaggggatttaatttgaaatactgaactggagaaaccaaagcaggatattcggaggagaagtcagtgcacatgagttttactgtgtcaggggatttaatctgaaacactgaactggagaaaccagaccaggatattcggaggagatggcacgagtcaggaggaagacagggtctctagtcctggctctggtaccctgggcaaatcactggactcctgataccagtttcctctctgtatgaggaaaagcatataccagataatctgggttcccttccatctctaacattcaataattgttaataccaaatgcagaaggaagagcaaaaatgtagctcaattttcaaagcccacagtgaggtcagtaatgatattccatttcttagttgaaaacactgctgacagccgtgaaaggtaaaattctatctatgccttacataaaaattgctgagcaacaaagaaacaataaatcaaggatgtcctagagatttaattttcttagcagaaactatgttagtcattaaataactgaatatcctactcctgataaacacccttacgtcaaacagcaagtggtacttcccatgcttccttaacaaggtaagaattacctacttcagcagccaccagcacagctgatgatagaacattagtcccttaactccccaaacaggaacaagataaaaatatctgtcgtcccaaccttgtgtaactttgttcagatagttctggcaaaggcaaatacaactcatgaaacataatgagaaaggagattgtcagaaaggagacaaaatgagcacagttagcaaacaatttgatggtctacccaaaaagcagccagaatcagtaaaatactcttaaaactgaaaaataatggagtaactgggctactaaaaaaataggaaaaacagaccccagtagaaacacgtgcaaaggacattaacaaatttacccccaaaaaagaaagacaatagctaataattatatttaaaagtttcaacttcagaaaaaaatatcacttttttgatatatactatgtgctaggtccacactgaaagacccttaccctctgagatagctgctgagaacacctacgttttataagcaaagaaatcgggccttagctctttaagtaccatgtctccagagaacccagggcaacaatggcagaatgacggctggaagccaggaccgcatggctctgtagttcactctcttaacaccatggtgcacagccttcccaaaaagcaatggtggagagtacattaaagatgccttttcaaaccatgaaccttgcaaatacaaaaacaattcatgctaatactgacaaagacaggcaatccttctcacgccatgcaagtaatacggaggcagcagggacagagcttggcccgtacccactcccgtattttccatacatcccccacgccatcacacctgcccaccagaccatgcaaaccagggagggaaacaagataagccatgttccaccccaaatcttacccaagggagttaagcctgatgcccacatgcatacaggatcagaacgacgatcctgacctcttgccttgttgtattactaaaaccctctcctcaggggctcatctgccatgccctgatcatgacacatctgtgctaacatgatgttccccggtgcctgccactagcgtgtgtaatgctgctgacacacctcatgactatccatgtcaccctaaaacaccaggaacacctgtcccgagggccagcccgggaactcctgcccctgtgccgctgccctcctgctccagcataagcccattataaagccttgtctgggacactttctctgtctcatgtcaatttccactgcatgagaatctaagaacccacgatcagtaacaatactgtaaattggtacaccagtatttcctgagtatgatttagaattatgtcaaaaataaaagtaaaatacaataaagtgaaggaagaaaagaaaatgtcatggaaacattcatactatctgaattaaaaattccacttctaggaatttcactgaaggtaaaactcacaggttttgtacataataaaacattatgtacaacattatgggatataaatagggctaataataataaaaatcacagtaatgacatgggaatacacaagattacattaaaaaagatataaaactatacatacaatttaaatttatccatgtaaattaggaaaaaaggtaagtgtaggcacaatttacagacagaatagagggaaatactatacaccaaatgtttctaacggtaatttttatgttttttgtgtttttctggattttcacattttctatagcatataatttatggagggggttggttaactcttctttttatgaaattactatatatacattcagtttaaaaatcaggtggtgttaaaagagatgttataaaagacaacaagctccttctcagccctcccaactccccagaagcaatcacttccaaaccctttgctctttcttctggtatttaccaccatatttctacataacgtgtatactactatttttgacctaataactttatcatgttttattttatgtatgtatttatttttattagggtaggggtctcacgctgtcgcccaggctggaatgcagttgcatgatcacggcccactgcagcctcgaactcctggcctcaagcaatcctttagcgtcagcctcctaaagtgctggaactacaggcacccggccaaattctagacattatctattgccttcctaatctagaggccgagggcccggtcccgatccacaggtttgctttattatcactaaatagcattcgatgctaagccaggtggtgggatgggaacccatttcctttttatgtaatgctgatttgccttatattaatagtgcctttcccccctttccttagttttctatgtactatgtattttcaaattctccccaaatgttctacaggtcagtcaaaccctttcagtacttttttcatatgcttcgacacaaggaataatctaccagctgcattttcctctccctccgtctgtcaccatgctgctgagcatgcgcgactttcacgccgaagagaaatgttcatagacggggacaagtttccctactataatacatggccaatttatagtttggcaggctggtcagactaattttttttctcaaacacagcacattgcttacagggcaaagaaattattttttcttatttaagtgttgatgacatattttaatatgtctaattttttaatgctttatgcaaacttacaaattgcacaaaccttagtagacttttgaacttctacaaatctgataaatcaagacatataaatctagtaagctagcctctcctaagactttcaaacagtacaatgattacaaaacttatttctatacctgtacttatgtctagcaaaagttattcattaatatcacagatttaattattttatctttgttatattttcctattcctttcctaaggtaacactaatgcttattttaacagtttcctatggggaaaattaatcttatggggttaaatcctaagggatcatccctttctgtaaaaacagggtggggctccctggttcatggtctttgtgcatcaaagcagtttctcagcacagggcacacactctttgatgccaagcatatctgactagttagggcagctttgagctccaatcctgccttcactgagattttataaggcctcaaccaaacaccaaatttcagtgtcttgtagcctgatgtccttccttaaaatgaaatacggagttttcctctatctgagttgcatagaccagtgttgtatggtataacttggtctttttgttgaatgtttaggcctttaagttggtttttacaactactgtgtttgttagcccaggaagctataataactaaactttttccatagcaatcctagacacagtgcaaacattactgaattcttttgtgcctttttaaggctcatcttgtttgcctcatctgaacttattaatgagcttgggctttttacaaacaatatatttcaatttgctgatgtttttttttcttcttgttctaattggctggtgggaatctctttaaattagttactttccctccaaacacacttactttatatgcaggagtccccagcagatccgtctgtggtctgttaggaactgggccacgcagcaggaggtgagcagcaggtgagcgaacatcaccgcctgagctccacctcctgttaggtcagtggcagcgttggagtcttgtaggagagtgaacctacggtgaactgtgcacgtggtgatcttggttgcatgctgcgtatgagaatcgaatgcctgatgatctgaggtggaacagttttatcttgaaaccatacccccaactttatcagtggaaaaactgtcttccacaaaaccagtctggtccctggtgccaaaaaggttggggaccattgctttaaagcaacagcaaagtcttaccaaaccattttagatttttctagtccaaagactagatatgataggtgcacaccaccacgcccagttcatttttattttttgtagagacagggtctcgctcggtggccgaggctggtcccaaactcccggcctcaagctatctttccacgttggcttcccaaagtgctgggattataggcatgagccaccaagcctagcttgggaaaaaaatgtaaggcacttgctgatttcctccagactggctctttgttctctttttctgtcaagtacaaaactcttagactgatatcatctgggacttctcacctttctccaggctgtgacacacacagaaaatgatgtttgtatgtcactttggggccaggctactcaccccaaaggtgaccagtgcagagctccagccacccagactcctcgagttggagggatctgttaacctgcccagggcacaacacccacacacaagttagaaagttctgctctggaagactgaaactggaccccttccttacatacaccatgtacaaaaatcaactcaagatggattaaaggcttagatgtaaaagccaaaactataaaaaaccctggaagacaatctaggcaataccattctggacataggaacaggcaaagatttcatgacaaagatgccaaatgcaatcacaacaaaagcaaaaattgacaaataggatctaattaaacttaagcactcctgcacagcaaaagaaactatcaacagagtaaacagccaacctacggaatgggagaaaatattcacaaactatgcatctgacaaaggtcaaatatccagcatctatatggaacttaaacaaatttacaagaagaaaacaaacaactccattaaaaagaaggcaaaggacatgaacagacacttttcaaaagaagacattcatgcagccaacagccataagaaaaaaggctcagtatcactgatcattagagaaatgcaaatcaaaaccacaatgagataccatctcacgccagtcagaatggctattattaaaaagtcaaaaattaagagatactggcaaggttgtggagaaaagggaacacttacacactgctggtgggtgtgtaaaacagttcaaccattggggaaagcagtgtggcgattcctcagagctaaaaacagaactaccattcaacccagcaatcccattactgagtatacaaccagaggagagaggaatagaaatcattctcccataaagatacacgcacgcgaatgttcaccgcagcactattcacaatagcaaagacatggaatcaacctaaatgcccatgcatggcagatgggataaagaaattgtggtacatatacaccatggaatactatgcaaccataaaaaagaatgagatcatgtgttttgcagaaacatggatggggctggaggccattatccttagcaaacacacgcagggaacagaaaaccaaataccgcatgttctcacttatgagtggaagctaaatgatgagaacgtggacacaaagaggggagcaacaaacactgggtcctatcagagggtggagggtgaagggtgggaggagggagaggaaaaaataactattgggtactaggcttagtacctgggggatgaaataacctgcacaacaacctgcgacatgagtttacctatgtcacaaacctgcgtatgtatcctgaacctaaatagaggtttaaaaggttaaaaaaaaaaagaagaaatcatataaatgaatgttctcttctgaccttattccctcatttacacttttcatcatgatatttgattccattttgccttctatactaattctttggataccacaattatagtttattgagtcttccgttccctgcgctgcctatctctggggtccttttgttatggtggctggtgtttgctttattttatttaggtctctcttttgtacctagactttccaaacattcctaacaacccttggatgtcagtacatagttaagaggaaaacacaaacaatgctggaagttctgtttacatggaggaagttctgtttacatggacaggacatgtcagctgggagcttcactgcagtgtgctcaagggatcagcagcttttttgtccgggaaccagcaaatgggagaactcttcggtgtggctatcggtggtgttctggaaggagatggggtggaagcagatgggggtcggggggcttctactggatctgtaatcccctcacgtccccactgcctcccccacagtgcctgcaggaccctgagtttgagcattttcattatcacttcgcaataatgcataaacactgaacaattaatcataaaaaagattggagagatccaaatcctaaaaggaaagaaaaaataaatccacatttaaagtttaccactcaagatactccaaatatcaacaaattataaacaatctagtgagatttttctatcgagggctttctgttatcctttcagcaaacgtgtgagtaacaaggatgcctgtttcacagtcacgttgcaaactcaagacctgtcaatggctttttaaggacctacttctttagcttcagtaaataagatagctaagtgtccttcatatatatatgtgaatacacatgtatatatgtacatagacaaatatttatgcaaaattaattgtttcaaaatttaaaaactataccatttaaaaataaaaaatgatatttaatcacagacataaaaactggatattaaagtcttattaatgaacaattttatgtattttttaaacaagcctaacaaatctatcctggcatcactttttttttcctgtagcatcaccagtaactgagcaatgttcacaattgattttattcaactaatcaagtcttaatttttttttaggtgtcactattgaattgtgcttctcaacttctattaaggatgcctttatttcctactaaatttaaccatttaaagactggtttaatggaaacttggacttcctgctttgtccctctgtttccttgtgcagtgtgtatgtgtgtgtgtgtgtgtgttgtgtgtgtatgtgtttaatatatctgagcagcctaacatataaatgggagttaaacattattttcaggctaggcgcagtggctcacatctgtaatcccagcactttgggaggccaaggcgggcagatcacgaggtcaggagtttgagaccagcctggccagcatggtgaaaccccattgctactaaaaatacaaaaattagccaggtatggagcccgggaggtggaggttgcagtcagccgaaatcgcaccactgcactccagcctggcaaaaaaaaaaaaaaaaaaaattttctttctttggatgccttggcttaatcccaagtgcagtaagcctggaaatgtaaggtgtgtggtcttccctgggaccgtacaacatctgcttgggtgcccttattattacatatgtggaaaagaatgttggttctattcatgctaatttcactctactgttactggtccgtgttaactgtttcatgctgaattgtaataaaatgcattggaattggccttaacttaaaatacttagtttacatagtcgagtatgaccaaagtacttttctctttggtggcacatcacaatggatgcaattactcagatacggtcctgaaatgagaacaaacgccatctatgctgataacagcagtcactggtgttaatcccagcacacataaaagccccagcaatacaaggccggcccaggaccttaactagaaggtcactgaacacatcagatctcatcgcatcaggcctgacccccaccagaaaggatgcaggcagctgcagggctgtcattaggcacgagagcatcccagaaagcaaaagtgcccaaaaaatggactcagatgccccctcgcatctgagtattcctgacagcatgtgaacattaattattaattttctgtacctcagttttccgaagccaatctttaggacaaaaaaaaaaaaaaaaaaaaggaagaaaataacttaaatgccaatttgtagttaaagtttcctctttgccttgaagacatcaaagcctgtaatagtttgcctgtagggagtttaattcaaacacagagcggtaaggagatccgggctggtccacacgatcgtctccacaggtctgggcgacctgaaagtgctgcggattggccaagcccagcacggccagtccagtgaacacacgcagggggcccggatggcaccgtttggcgccgaacccctcggcctctctccgcctcccgcccggctcctaacacccggcgccccaagact

SEQ ID NO: 231 - DNA, 23151 bp, Homo sapiens
tgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacccagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattctacaaagaaaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgagaatataacaaaatctgacctgttccttctgcctctgctgctaccagcctagccctggaatattgtgataatatgattgtgattgttcccagcacagtggccagaggggcccggtagaacctaaggcagatcacattgttctttggctggacacccttccctggctccccatttactcggagcaggagctgaaagtccctaaaaagcctggaattgtgataagagctcgtccccagttccctctccctttgcttatctgctacagtcacagaggcctcctcactgcactgccagcaaacccagttcatctcatctctacgcagtaagcttgtcctccagaacctggagagtgaacttctgcctctttacggtctttgttcaaaaaccaccttggcagagaagctgtccttgatagatcttacctgaccctacactcccaccccaaacacagattcctatcccctcccttggtatgtctctgtaccatttaccactgtctaatatgctcctattttcttatttatgcttgctgtctctcccccaagaaaacataagcttcaccagggcaagcatgctttgcttgttttgtgcatggctgaaaaatacctagcaccatgcctgatacatagaagacactcagtcaggttaggcatggtggctcatgcctgtaatcccaccattttgggaggctgaggcagacggatcacctgaggtcaggaaatcgagaccagcctggccaacatggtgaaaccccacctctactaaaaatagaaaaattagctgggcatggtggtgcgctcctgtaatcccagctactcgggaggctgaggtaggagaatcacttgaacccgggaggcagaggttgcagtgacccaagattgcaccgctgcactccagcctgggagacagaccgagactccatctcaaaaaaaaaaaaaaaaaggcactcagtcaatctctgctgaataaatgataaatgcataaacgaattaatgagctgggatgctaaaaaggccaggcaacatttacacatctcaccagaaaaaactgcactggtcaccaaccccagccagccaatgagaaagactggaggccaggaaccacaccccatccaacaatccccctcagttcctgactcggagctgctcctgtgagttgagtaaataccctgcaataggcacagtcaaagacgccgtatggtccccagtctctggtgtagcacattcttctgtgttaaatggaataaataaaatacactgcggcggcagctttctgctttcacgtggtagaggctcgcctgggctggcccttagcctttggctagagcagtctcctgggcctcggctgccccactcatttccttggccagcagtaggcatgtttcttccataactgaccagacaggaactattttccggtttgtggctacatgtaccatctccgtcacaacgactcagctgttgttacaggatgaaataagtaagtaaataagcatgggccaggcgtggtggctcacgcctgtaatcccagcactgtgggaggcccgggcaggtggatcacctgaggtcaggagttcgagaccaacctgaccaacatggtgaaaccccgtctctactaaaaatgcaaaaattagccgggcatagtggcacacacctgtaatcccagctactcaagaggccacggcaggagaatcacctgaacccgggaggcggaggctgcagtgttccgagatggcaccactgcactccagcctgggcaacaagagagaaactctgtcttggaaaaaataaaaaataaaaaaaaaaaataagcatggctgtgtttcagtaaacctttaaaaaaaattaggtggtgggctggctttgctgtaggctgaagtttgctgacccctgccttcagtaattcctccctgcaccccttcagggtccaaagcctccaatcttgcaatataaaaagatctaaccttagtgactgaatgattcactaaatacacaattatatagacaagttccagtttatatagaaggtaatgaaattaaaataagaatctgtatcaactcaaaatctgtgcccttggaggtacacctctggcctcaggctggtacgctcaatactgcagccccttccttcacccttcttcactgcagaactcagaaagcatgacgggattccacatctccccaaacccacaagacctatagttctggcctacaccatatagaaagcagctttccctttctgaaacgcagaaccactaaggggaaggtttaggctcccctcccctcccttgttcctccccctccctgccaccgggactgctgaagccagctcagccatcttgtgaccatgaggaagaaggcgacgtgctgagaatggtggagccgcctccctgggatcatcgccccagtgccagaccagcccaggtctcacctgcctccagacctcctagcaggggagatgagctcctaggagataaaccatggtgaaccggggtttctgttatctgtagtcaaagcccttgtacatcttgttaatcattaaattttaaagagagaaattattttgccaggggaaaatagcacagttcatttcagaataaagcttcaaagaaaataattctttctgaattgcgaggagaacagacaatgaaaataaatttcttgaaaaactgaaggctcaagttcaagttagcctggaagatctaactatggtcaatgatcaagaatacactgtaattaatctattctgtttactttgtctatgttcaaaaatttctatagttaaagaaaaacaaaacaagagacaataaagaagattcagtgagaggaagataaagggccatcagcaaatgacatcttccacgctggaggtggttaatctcagtgtctatctacatgtttggtttggttgttttaaaacaaaaatctgtacttatccttactatcaagagaggactgaatatcactcatcggttcagcatttactaagcaccagctacgtgtctggcacttgtcagagagtcctccctgctcagcctcaattcagcaggctgagttgttccgctcctgcagtgtggcacggaggccagcaggaggcgcggtagcggggcttcccgggacgccgccagaaagaaaggagtgggtaggtcctgatgggaatgaagctagagaaaaggaggaaatgtccgctagaagatggcacgccatatctggagtctgagctttaagaccttgatcgagcctgagggctgcagcttcagacttgccctgtaggtggcagggcggatgccaggcgcccagggacacgaggccacccaatggatgtcaagcaggaggggcagggacagaaaggccccacggctgcagacgcgggaggccccgagccggagacgctcgtgtgaacacaggcgctgctcctgtcacggccccttactcgccttgctgactttaaacagtctctcctcggtgttctccttgtcaaactgttcatcccagtttcctctgaaatagacagcattcaccagaaccagccttgtcaatggatccactgagcccggagagagcaactccgcaattttacctgagcggaagaattcaagaccgcattagataggggcggctgcggatccccgacacatcaggaatcggctggggccttctccttcagcagtcaagtgcacggatagagagttccactgtcccccaaatataaagggatacgtgtccttaaagcaaaacaacaaaatcttctggtacgaaaaacatcatcaattgaataaaacacacaaagtgaacaaatatgcgttaattatgcaggatgagttcctaacacatgagataagaagcaatcatgggtgcctatgacttaaagacaagaacttaaaggattatcaaaaaggtgggcagtcagaagatgttctttacaagcttaaagaacagttaggccagacacagtggctcacacctataattccagcagtttgggaggctgaggtgtgaggatcacttgaggccaggagtttgagaccaacctggacaacatagtgaggccttgtctcttaaaaaaaaaatttattaaaattagctgggcatggtggtgctacctgtagtcccaattacttgggagactgaagcaggaggaccgcttgagcacaagaattgatgctgtaatcccagcactttgggaggccaaggcgggtggatcacgaggtcaagagattgagatcatcctggccaacatggtgaaaacctgtctctactaaaaaatacaaaaattagcagggcatggtggcacgtgcctgtgatcccaactacttgggaggttgagataggagaatcacttgaacctgggaggcagaggttgcaatgagccaagattgcaccattgcactccagcctgggcaataagagcaaaactccatctcaaagaaaaaaaaagaaaattgaggctgcagtgaattgtgattgtgtcactgcattccagcctaggtgacagagggagaccttgtctcaaaaaaaaaaaaaaaaaaagtttaaattaagaaccacagatagaccagggcgtgacccagtgtcccacagcaatgcatggcaactgtagactgtgctacccaagagggaggcagcttgagatccacactgcgaattttttatgttacttgtgaaaggaaaaactatattaacattaacacactaaccccctcctcaaaattaaaacgtggattgatccagaagaggtataccaaacactgaaaggcatcacgggtacaccaaggaaacagggagaaatcagagagaacagaacacattgagcatttccaaaatgtcaaataatggcaactgatttcagaagcagattttttaagtttgcagttattcagagaaaaaaaaatcattcctgtttacaattgacagtcttgtgaaggaactgacaataaaatggattaagaggttattacaaaagtagaataacaatacattttcaccttctgtcttttcagctacccaggtgtttatgtgttttctggacttctctacggcgctgataaagtcaagctcctccatctctgcttggtagaatttttggcaggaatctctaaaagactaggatagacagagtgacataactgcctggctacaaaaatgatgaacaccaacggcctacttcttcattgcaccaagtcagaaaatctataattttatgattgacatacataatttacaaataaatatgaggacttaacctaaactacaacttcctagctttagctatatttaatcctagcttaaaaactaagtcaaggtcaggtactgtggcttacacttgtaatcccagcactttggggggccgaggcgggtggatcgtgtgagctcaggagttcgagaccagcctggccaacatggcgaaagcccgtctctactaaaaatacaaaaattagccatgtatggtggcatgcacctgtaatcccagctacttgggaggctgaggcaggagaatcacttgaacccagaaggcggaggttgcagtaagccgagatcaggccaccacactccagcctgggcgacagagcgagattctgtctcaaaaaaaaaaaaacaaaaaaaaaaaagcaaaaaacactaagttgaatcagtctctgaatatcaaacgaacttcaccaactgctggatcctttaagggagcagccatgcatcaaggagctgcctgacaagatgctgacaagacacttcaaaagcgtgaagtagatccaccttattgaaatgcagagaatttaaaacatattggcaggtgaaaagaaattacaaaagcctatgtatggcataatggcatttagagccacacgcttcctgctgggccccagcccccactacctggccacctttatttctttagtgaataagagcaagtatgacttactgagaggaaatcacaagacttttccccaaagagcctgttggccatcctaagcaagtactgcgtgccagtcttgttcacttcggtgagaagagactggaagccctggtggatgtctccaccaccgccacttttattgaaagaaagtatctgaaatcaaaaacagaatgaaaacaaatcattcctgtatgctctgacttcaggaaatggggcaaccccaaactcagcctaacaaccatccagacccttattactgcttaaaagatctatccgaggctgggcgcagcagctcacgcctataatcccagcactttgggaggccaaggcgggaggatcacctgaggtcaggagttcgagatcagcctggccaacatggcaaaaccccatctctactaaacacacaaaaatgagctgggcctggtggtgcgtacctgtaacccagctactcgggaagctgaggaaagagaatcgcttgaacccgggaggcggaggttgcagtgagctgagatcgtgccactgcactctagcctggcgacagagtgagactccgtctcaaaaaaaaaaaaagatccatctgattaaaggccagaagggtcttgaaagcccctccctgtaccctgtctgtgctggcatgagctgcaacgccctccacaaacccaggctcctgatgctcagtacttggagtctggtggcaaacaagggtgccaaccagacctcctgtctatacaaacacaggccgcccctgacatcagaaggggcagactccctcctgcccgtggctctggaatgcccgtgtcactggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtagagagagttgcttgaagaactgaggcctctagccgggcgtggtggctcacacctgcaatcccagcactttgggaggccgaggcgagtgcatcacctgaggtcaggaatttgagaccagcctgaccaacgtggagaaaccccatctctactaaaaatacaaaattagcctggcgtggtggtgcatgcctgtaatcccagatactcgggaggctgaggcaggagaatcacttgaacccgggaggcggaggttgcagtgagccgacatcgcgccattgtgctccagcctgggcaacaagagcaaaactctgtctcaaaaaaaaaaaaaaatcgaggtttcaggtgtgagagaggccttcttgaaccttccgggccaggtgtccactgaaacagctgcatgagtgacctgcactgcttcctgggagcagtcctgcctgctcaggccacggaatctgagaaataatcaatcattgttatttccagccactaagtttgggatggtttgttttgtggcaacagctgacacatgcagccatccagaagtggaattctgccatgaccaaaacctaaaacatgtggacttggccttggacccaggcagctggcagaggctggacggacaggacgaaatgactcctgggggctggagaaagggggctgtgtgtgtaccagctgaagaagtggaaagaaggtcaccctcagtgacagggaggatggagtgcctcccccgggaactcctgcatctggctaaggggtccaggaggaagctggcttctttttgctgcctagggtaacacatgggaagagaaagatgaaggaactgttccattttcaagcagaatttaaaggaactatttccaatccaggatgtactgggtggagaataaaaatgtttcttcttcccagcctttccagctggcaaaagattctaaaagagatggcctcagggcaaagatcaaatcccagacactggcctcaagggtgaggtccaaatccactttgttaaaccttagaagattcagacagcatcttatagaccatctggcaggctctcccatggcaccctgactcccaacccaacaaagagcactcaggatggcggtgggggtgcttttgtccagggaagcagaattttaagttgatagaaattccacagtggttttcaggcacttgtaacagcttggactaaaagagagagacggctcaaagtgcagggaggcctctgggtgcccacgttctacaggtgggaggtaggctgggagcgcagcaagcacgggccatttcttacagaacaggaaaggagctgccaagagcgacaccaggacacagagggcagagcacagccagggcagcaacggacaagggacaattctgggaagctgcagtggaggctcatcaaggaacaccctgcacccagggctgagaggtgaacaatacatgcctggctgggcttgggaattgccactgctccgtgacggccacgtgcctcccacgcctactgtgatgggctgcatgtgtcccctcaaatttacacactgaagtcccaactccagtgtctcaggatggaactgcatttgcagagagggcctttacaggggtgattaaggtaacataaggccattaggttgggctttaatccaataggactcatgtccttataaaaagaggagatgaggacacagacacacacagagagatgaccatgtgaggacacagggagaaaacagtgtctacaagccgaggagaaaggctgcaggagaaaccaaccctgcctacacctggatctcaggctcccagggaaccaccaggtccagagggcagaccacagcagtcacgggtggccccgaccagctacatctgtggtgtgcgcaccctctctcaacccctctcaggcgcggagatgcctctgcctttggcagtggggccttggcaagcaggacacaggcggggacgtgatgggtacttgtttcaagcctgtcttctgcgagcacttcctctcagaacccagccgccaggcctacggaagcccaggcaacgctgctgaaggaagcatgtggaaggccccagcggagaaggccacggagaagacgcccagcgccccgctgagcccccgctgacgcagcccacaagggacccacccagtgccaagtggtgcagaagcaccactcaatccacccagattcaacaaccaggaaagctgctaagctgggagagctggttacacaacaacaaataaccagaacgctactgaaaacatgtttagctgacaaatgccattctaagaaggctttacgcgtaaatgagaaaataaagactcctaacaaccaacaagcagatgacagtacccaaagatcatcacaggactcaacctgaaccttgtgactttacaaccatctacaaactcacgaacaagctaagccatgtgatgatgaaatcattcattcctctgaatcgggcgccccctctccaccccagggggtcagtcagggtgttgtccccagggtgctccagcatgggtggcatgcccttccctgtaaactcgccacccacaccctgcaatactgcacagtcatccgtctcgagcgatccctttgggatttggaataaggaggaccagctaacttgacagttaatagcaccatggctgccctgaagctgtacctgggccatctgtgcagcggtgtttccctttgcccccatgtagaccatggccagggcacaggacatgctcatgggtgagaaaaacacattcttcgagttgtctttacccagcgttttcaaaaggtttaaggcaaaggtgccatttgcttctgcgagaacatccatgatggcagacctggaacaagatttaaaatcagtatcacttaagcacagcttccacgcgactgcatctcacgcgccttaccgacagtcaccgccgatgctgtggttcagtgggcaagcagaaacacacacagaactctggctgtttctttttaggaccctccacattattttgtgtgtttctaatgttaagtgtggaaaatgaaagagttctatgtgaaacgccgccctgttttgtgaggactcctccctgcacgcctgcccgcacgtggagaaagtgggaaggaggcaccctttcctggagtctcttccttggggtggaattacagaaggggcactggcttttgcttctatgtttgtattctttggtgtgttttgcgggcttaaatgtactgttttaatttgaaaaatattcaaaatgatacattcactgacagttacacaagaaaagatggccaaatgtttttataatgagagagagaatcccatttctgggtagcaagagccttaaaaaaggatcaatcaagccacatacaaagatgcgtgaaagcctttcaaatgcctcctgacccttggatctccttctaggaaatccctgcaggtggcaaagccccaattttggaccacgcttggggacatcctgctgcaacaagccaggccttcctgcgcctgaactcacagcacactcaggacaccaccttgcctcatgggctgtgggtgcatgcccatctccaccttcacagacaggctcaggggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatcaatgccccactgcactacagggaaggtgaagttgacggaagtgaagctaagaagtagctgggcttgaaacgcagggcggatgcgctttctgagctgctgctcaagaagaagaatctgcagaatcaggtgagaggacaaggggcagctaagggccccacaggcagtcaggctgggaaggaggggatgcaggaatgcagggatgcggggcctgcctgctctgacacagttctcagatgtttaccaaatgaatatgtcccagtcagagaatgccagcattctaagacagtcccagtgactcacttgagcagtgagtgggaacccacggaacaaggaaggggagaagctggagcagacatttcctggagcagatgggagagggaaggaggtgcctactggaggccctgtgaggagatgctgaattaagcggctctccactgtgcatgcctttacatttggagctggggttggctgagcaagtgctccaaagatacctgggtcataatccctgggacctgtgaatgccccttacatggcaaaagggactgtgcagcacgattagattcaggctcttgagatgggagattatcctggattgttccagttgaccctaaatgtaatcacaggtatccttctaagagggagggagggggagatctcacgggaaaaagcaatgcaaagaataaagcaaaatgccactccactggccttgaagatgaagggcctcaagccaagaaacgcaaggaccacagctgcagtagctggaaaggcaaggaggatcctctggaggagcctggccctgcggaacccatttccaacctccaacctcagaactctgagaaaataaacatgtgcagtttagccacgaatccatggtcatttgttacagcagccacgggaaaccaagacaataactcatacacctgataaagcttgtttgctgtgcttgtttaaatattttgttttcaaactcttctttattcattacacagaatacttggggcactgggcactcctggcttgccaagcctttccaaacatattttaagattactaatttctaataaaaggacaatagaaagtacatattactaaaattcttctgaatataagggagtctttgatgatacataaataaatccaggattccgcagagccctgggaacaccagtataaacaaaagtagccattacacggaactgaagcaaaattgggcctatttttggttctttggattctagatcacaagaactgcccgcttatcaacttgaagagaaacaattggtaaaacagggaaacttctaggttaagaataagaaaagaggagatgccccaaagcaagaagcacagcctgtgaagtccgtgtctcaggactcaaagccagcagacaccctgacacgtggggttttccctggcctggggacatggacttctgtctttgtccccaagagggctcagcccacgtggagaggctgccaggtgagatggctcctccataaaccaaaaaaaaaagacagaggttaagtaccatgtcagctggccaggggaaggtcccacatgctcccccaaccccatcctagactattctaccgtcagcacacgttttcccctcaaatgctgaaggactcttacgcttttttttttgtagagacaaggttcttgccaccttgcccaggctgctctccaacgcctggcctcaagtgatcttcctgcctcagcctcccaaggtgctgagattacagccatgcaccacgcccagcctaaaggacttttaattcaaatggaaatgtccacctaagaaaggctaataataaaacactccgtctccggtaatatcccggagaatctgtttcaggcgctgatctttatatcagtaacttcaacaaagcaaagccacctttgtctgaagacacgcccactggggaggtgcctgtctggccagcccaggttacaccatctggggcagaggagaagtcggtgcacatgagtttcactgtgtcaggggatttaatttgaaatactgaactggagaaaccaaagcaggatattcggaggagaagtcagtgcacatgagttttactgtgtcaggggatttaatctgaaacactgaactggagaaaccagaccaggatattcggaggagatggcacgagtcaggaggaagacagggtctctagtcctggctctggtaccctgggcaaatcactggactcctgataccagtttcctctctgtatgaggaaaagcatataccagataatctgggttcccttccatctctaacattcaataattgttaataccaaatgcagaaggaagagcaaaaatgtagctcaattttcaaagcccacagtgaggtcagtaatgatattccatttcttagttgaaaacactgctgacagccgtgaaaggtaaaattctatctatgccttacataaaaattgctgagcaacaaagaaacaataaatcaaggatgtcctagagatttaattttcttagcagaaactatgttagtcattaaataactgaatatcctactcctgataaacacccttacgtcaaacagcaagtggtacttcccatgcttccttaacaaggtaagaattacctacttcagcagccaccagcacagctgatgatagaacattagtcccttaactccccaaacaggaacaagataaaaatatctgtcgtcccaaccttgtgtaactttgttcagatagttctggcaaaggcaaatacaactcatgaaacataatgagaaaggagattgtcagaaaggagacaaaatgagcacagttagcaaacaatttgatggtctacccaaaaagcagccagaatcagtaaaatactcttaaaactgaaaaataatggagtaactgggctactaaaaaaataggaaaaacagaccccagtagaaacacgtgcaaaggacattaacaaatttacccccaaaaaagaaagacaatagctaataattatatttaaaagtttcaacttcagaaaaaaatatcacttttttgatatatactatgtgctaggtccacactgaaagacccttaccctctgagatagctgctgagaacacctacgttttataagcaaagaaatcgggccttagctctttaagtaccatgtctccagagaacccagggcaacaatggcagaatgacggctggaagccaggaccgcatggctctgtagttcactctcttaacaccatggtgcacagccttcccaaaaagcaatggtggagagtacattaaagatgccttttcaaaccatgaaccttgcaaatacaaaaacaattcatgctaatactgacaaagacaggcaatccttctcacgccatgcaagtaatacggaggcagcagggacagagcttggcccgtacccactcccgtattttccatacatcccccacgccatcacacctgcccaccagaccatgcaaaccagggagggaaacaagataagccatgttccaccccaaatcttacccaagggagttaagcctgatgcccacatgcatacaggatcagaacgacgatcctgacctcttgccttgttgtattactaaaaccctctcctcaggggctcatctgccatgccctgatcatgacacatctgtgctaacatgatgttccccggtgcctgccactagcgtgtgtaatgctgctgacacacctcatgactatccatgtcaccctaaaacaccaggaacacctgtcccgagggccagcccgggaactcctgcccctgtgccgctgccctcctgctccagcataagcccattataaagccttgtctgggacactttctctgtctcatgtcaatttccactgcatgagaatctaagaacccacgatcagtaacaatactgtaaattggtacaccagtatttcctgagtatgatttagaattatgtcaaaaataaaagtaaaatacaataaagtgaaggaagaaaagaaaatgtcatggaaacattcatactatctgaattaaaaattccacttctaggaatttcactgaaggtaaaactcacaggttttgtacataataaaacattatgtacaacattatgggatataaatagggctaataataataaaaatcacagtaatgacatgggaatacacaagattacattaaaaaagatataaaactatacatacaatttaaatttatccatgtaaattaggaaaaaaggtaagtgtaggcacaatttacagacagaatagagggaaatactatacaccaaatgtttctaacggtaatttttatgttttttgtgtttttctggattttcacattttctatagcatataatttatggagggggttggttaactcttctttttatgaaattactatatatacattcagtttaaaaatcaggtggtgttaaaagagatgttataaaagacaacaagctccttctcagccctcccaactccccagaagcaatcacttccaaaccctttgctctttcttctggtatttaccaccatatttctacataacgtgtatactactatttttgacctaataactttatcatgttttattttatgtatgtatttatttttattagggtaggggtctcacgctgtcgcccaggctggaatgcagttgcatgatcacggcccactgcagcctcgaactcctggcctcaagcaatcctttagcgtcagcctcctaaagtgctggaactacaggcacccggccaaattctagacattatctattgccttcctaatctagaggccgagggcccggtcccgatccacaggtttgctttattatcactaaatagcattcgatgctaagccaggtggtgggatgggaacccatttcctttttatgtaatgctgatttgccttatattaatagtgcctttcccccctttccttagttttctatgtactatgtattttcaaattctccccaaatgttctacaggtcagtcaaaccctttcagtacttttttcatatgcttcgacacaaggaataatctaccagctgcattttcctctccctccgtctgtcaccatgctgctgagcatgcgcgactttcacgccgaagagaaatgttcatagacggggacaagtttccctactataatacatggccaatttatagtttggcaggctggtcagactaattttttttctcaaacacagcacattgcttacagggcaaagaaattattttttcttatttaagtgttgatgacatattttaatatgtctaattttttaatgctttatgcaaacttacaaattgcacaaaccttagtagacttttgaacttctacaaatctgataaatcaagacatataaatctagtaagctagcctctcctaagactttcaaacagtacaatgattacaaaacttatttctatacctgtacttatgtctagcaaaagttattcattaatatcacagatttaattattttatctttgttatattttcctattcctttcctaaggtaacactaatgcttattttaacagtttcctatggggaaaattaatcttatggggttaaatcctaagggatcatccctttctgtaaaaacagggtggggctccctggttcatggtctttgtgcatcaaagcagtttctcagcacagggcacacactctttgatgccaagcatatctgactagttagggcagctttgagctccaatcctgccttcactgagattttataaggcctcaaccaaacaccaaatttcagtgtcttgtagcctgatgtccttccttaaaatgaaatacggagttttcctctatctgagttgcatagaccagtgttgtatggtataacttggtctttttgttgaatgtttaggcctttaagttggtttttacaactactgtgtttgttagcccaggaagctataataactaaactttttccatagcaatcctagacacagtgcaaacattactgaattcttttgtgcctttttaaggctcatcttgtttgcctcatctgaacttattaatgagcttgggctttttacaaacaatatatttcaatttgctgatgtttttttttcttcttgttctaattggctggtgggaatctctttaaattagttactttccctccaaacacacttactttatatgcaggagtccccagcagatccgtctgtggtctgttaggaactgggccacgcagcaggaggtgagcagcaggtgagcgaacatcaccgcctgagctccacctcctgttaggtcagtggcagcgttggagtcttgtaggagagtgaacctacggtgaactgtgcacgtggtgatcttggttgcatgctgcgtatgagaatcgaatgcctgatgatctgaggtggaacagttttatcttgaaaccatacccccaactttatcagtggaaaaactgtcttccacaaaaccagtctggtccctggtgccaaaaaggttggggaccattgctttaaagcaacagcaaagtcttaccaaaccattttagatttttctagtccaaagactagatatgataggtgcacaccaccacgcccagttcatttttattttttgtagagacagggtctcgctcggtggccgaggctggtcccaaactcccggcctcaagctatctttccacgttggcttcccaaagtgctgggattataggcatgagccaccaagcctagcttgggaaaaaaatgtaaggcacttgctgatttcctccagactggctctttgttctctttttctgtcaagtacaaaactcttagactgatatcatctgggacttctcacctttctccaggctgtgacacacacagaaaatgatgtttgtatgtcactttggggccaggctactcaccccaaaggtgaccagtgcagagctccagccacccagactcctcgagttggagggatctgttaacctgcccagggcacaacacccacacacaagttagaaagttctgctctggaagactgaaactggaccccttccttacatacaccatgtacaaaaatcaactcaagatggattaaaggcttagatgtaaaagccaaaactataaaaaaccctggaagacaatctaggcaataccattctggacataggaacaggcaaagatttcatgacaaagatgccaaatgcaatcacaacaaaagcaaaaattgacaaataggatctaattaaacttaagcactcctgcacagcaaaagaaactatcaacagagtaaacagccaacctacggaatgggagaaaatattcacaaactatgcatctgacaaaggtcaaatatccagcatctatatggaacttaaacaaatttacaagaagaaaacaaacaactccattaaaaagaaggcaaaggacatgaacagacacttttcaaaagaagacattcatgcagccaacagccataagaaaaaaggctcagtatcactgatcattagagaaatgcaaatcaaaaccacaatgagataccatctcacgccagtcagaatggctattattaaaaagtcaaaaattaagagatactggcaaggttgtggagaaaagggaacacttacacactgctggtgggtgtgtaaaacagttcaaccattggggaaagcagtgtggcgattcctcagagctaaaaacagaactaccattcaacccagcaatcccattactgagtatacaaccagaggagagaggaatagaaatcattctcccataaagatacacgcacgcgaatgttcaccgcagcactattcacaatagcaaagacatggaatcaacctaaatgcccatgcatggcagatgggataaagaaattgtggtacatatacaccatggaatactatgcaaccataaaaaagaatgagatcatgtgttttgcagaaacatggatggggctggaggccattatccttagcaaacacacgcagggaacagaaaaccaaataccgcatgttctcacttatgagtggaagctaaatgatgagaacgtggacacaaagaggggagcaacaaacactgggtcctatcagagggtggagggtgaagggtgggaggagggagaggaaaaaataactattgggtactaggcttagtacctgggggatgaaataacctgcacaacaacctgcgacatgagtttacctatgtcacaaacctgcgtatgtatcctgaacctaaatagaggtttaaaaggttaaaaaaaaaaagaagaaatcatataaatgaatgttctcttctgaccttattccctcatttacacttttcatcatgatatttgattccattttgccttctatactaattctttggataccacaattatagtttattgagtcttccgttccctgcgctgcctatctctggggtccttttgttatggtggctggtgtttgctttattttatttaggtctctcttttgtacctagactttccaaacattcctaacaacccttggatgtcagtacatagttaagaggaaaacacaaacaatgctggaagttctgtttacatggaggaagttctgtttacatggacaggacatgtcagctgggagcttcactgcagtgtgctcaagggatcagcagcttttttgtccgggaaccagcaaatgggagaactcttcggtgtggctatcggtggtgttctggaaggagatggggtggaagcagatgggggtcggggggcttctactggatctgtaatcccctcacgtccccactgcctcccccacagtgcctgcaggaccctgagtttgagcattttcattatcacttcgcaataatgcataaacactgaacaattaatcataaaaaagattggagagatccaaatcctaaaaggaaagaaaaaataaatccacatttaaagtttaccactcaagatactccaaatatcaacaaattataaacaatctagtgagatttttctatcgagggctttctgttatcctttcagcaaacgtgtgagtaacaaggatgcctgtttcacagtcacgttgcaaactcaagacctgtcaatggctttttaaggacctacttctttagcttcagtaaataagatagctaagtgtccttcatatatatatgtgaatacacatgtatatatgtacatagacaaatatttatgcaaaattaattgtttcaaaatttaaaaactataccatttaaaaataaaaaatgatatttaatcacagacataaaaactggatattaaagtcttattaatgaacaattttatgtattttttaaacaagcctaacaaatctatcctggcatcactttttttttcctgtagcatcaccagtaactgagcaatgttcacaattgattttattcaactaatcaagtcttaatttttttttaggtgtcactattgaattgtgcttctcaacttctattaaggatgcctttatttcctactaaatttaaccatttaaagactggtttaatggaaacttggacttcctgctttgtccctctgtttccttgtgcagtgtgtatgtgtgtgtgtgtgtgtgttgtgtgtgtatgtgtttaatatatctgagcagcctaacatataaatgggagttaaacattattttcaggctaggcgcagtggctcacatctgtaatcccagcactttgggaggccaaggcgggcagatcacgaggtcaggagtttgagaccagcctggccagcatggtgaaaccccattgctactaaaaatacaaaaattagccaggtatggagcccgggaggtggaggttgcagtcagccgaaatcgcaccactgcactccagcctggcaaaaaaaaaaaaaaaaaaaattttctttctttggatgccttggcttaatcccaagtgcagtaagcctggaaatgtaaggtgtgtggtcttccctgggaccgtacaacatctgcttgggtgcccttattattacatatgtggaaaagaatgttggttctattcatgctaatttcactctactgttactggtccgtgttaactgtttcatgctgaattgtaataaaatgcattggaattggccttaacttaaaatacttagtttacatagtcgagtatgaccaaagtacttttctctttggtggcacatcacaatggatgcaattactcagatacggtcctgaaatgagaacaaacgccatctatgctgataacagcagtcactggtgttaatcccagcacacataaaagccccagcaatacaaggccggcccaggaccttaactagaaggtcactgaacacatcagatctcatcgcatcaggcctgacccccaccagaaaggatgcaggcagctgcagggctgtcattaggcacgagagcatcccagaaagcaaaagtgcccaaaaaatggactcagatgccccctcgcatctgagtattcctgacagcatgtgaacattaattattaattttctgtacctcagttttccgaagccaatctttaggacaaaaaaaaaaaaaaaaaaaaggaagaaaataacttaaatgccaatttgtagttaaagtttcctctttgccttgaagacatcaaagcctgtaatagtttgcctgtagggagtttaattcaaacacagagcggtaaggagatccgggctggtccacacgatcgtctccacaggtctgggcgacctgaaagtgctgcggattggccaagcccagcacggccagtccagtgaacacacgcagggggcccggatggcaccgtttggcgccgaacccctcggcctctctccgcctcccgcccggctcctaacacccggcgccccaagactgagcacgcgtcctccgggtcgcggagcgggcgaggggtcaccgaggccgcggggccgaccggggtcacctgtggcccgggaggctctgcgccgcccccatcccgcgccggccgcctcttccgtgggcgctgggcctgggcgcccggggtcctcgggtccgcggcgtcaccggccgggctcgcggccacgcacgactcacccggccgcgtcgccgttctctgccgctgcgaggctccggaagggaacccaagccggacgctc

SEQ ID NO: 232 - DNA, 24007 bp, Homo sapiens
tgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacccagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattctacaaagaaaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgagaatataacaaaatctgacctgttccttctgcctctgctgctaccagcctagccctggaatattgtgataatatgattgtgattgttcccagcacagtggccagaggggcccggtagaacctaaggcagatcacattgttctttggctggacacccttccctggctccccatttactcggagcaggagctgaaagtccctaaaaagcctggaattgtgataagagctcgtccccagttccctctccctttgcttatctgctacagtcacagaggcctcctcactgcactgccagcaaacccagttcatctcatctctacgcagtaagcttgtcctccagaacctggagagtgaacttctgcctctttacggtctttgttcaaaaaccaccttggcagagaagctgtccttgatagatcttacctgaccctacactcccaccccaaacacagattcctatcccctcccttggtatgtctctgtaccatttaccactgtctaatatgctcctattttcttatttatgcttgctgtctctcccccaagaaaacataagcttcaccagggcaagcatgctttgcttgttttgtgcatggctgaaaaatacctagcaccatgcctgatacatagaagacactcagtcaggttaggcatggtggctcatgcctgtaatcccaccattttgggaggctgaggcagacggatcacctgaggtcaggaaatcgagaccagcctggccaacatggtgaaaccccacctctactaaaaatagaaaaattagctgggcatggtggtgcgctcctgtaatcccagctactcgggaggctgaggtaggagaatcacttgaacccgggaggcagaggttgcagtgacccaagattgcaccgctgcactccagcctgggagacagaccgagactccatctcaaaaaaaaaaaaaaaaaggcactcagtcaatctctgctgaataaatgataaatgcataaacgaattaatgagctgggatgctaaaaaggccaggcaacatttacacatctcaccagaaaaaactgcactggtcaccaaccccagccagccaatgagaaagactggaggccaggaaccacaccccatccaacaatccccctcagttcctgactcggagctgctcctgtgagttgagtaaataccctgcaataggcacagtcaaagacgccgtatggtccccagtctctggtgtagcacattcttctgtgttaaatggaataaataaaatacactgcggcggcagctttctgctttcacgtggtagaggctcgcctgggctggcccttagcctttggctagagcagtctcctgggcctcggctgccccactcatttccttggccagcagtaggcatgtttcttccataactgaccagacaggaactattttccggtttgtggctacatgtaccatctccgtcacaacgactcagctgttgttacaggatgaaataagtaagtaaataagcatgggccaggcgtggtggctcacgcctgtaatcccagcactgtgggaggcccgggcaggtggatcacctgaggtcaggagttcgagaccaacctgaccaacatggtgaaaccccgtctctactaaaaatgcaaaaattagccgggcatagtggcacacacctgtaatcccagctactcaagaggccacggcaggagaatcacctgaacccgggaggcggaggctgcagtgttccgagatggcaccactgcactccagcctgggcaacaagagagaaactctgtcttggaaaaaataaaaaataaaaaaaaaaaataagcatggctgtgtttcagtaaacctttaaaaaaaattaggtggtgggctggctttgctgtaggctgaagtttgctgacccctgccttcagtaattcctccctgcaccccttcagggtccaaagcctccaatcttgcaatataaaaagatctaaccttagtgactgaatgattcactaaatacacaattatatagacaagttccagtttatatagaaggtaatgaaattaaaataagaatctgtatcaactcaaaatctgtgcccttggaggtacacctctggcctcaggctggtacgctcaatactgcagccccttccttcacccttcttcactgcagaactcagaaagcatgacgggattccacatctccccaaacccacaagacctatagttctggcctacaccatatagaaagcagctttccctttctgaaacgcagaaccactaaggggaaggtttaggctcccctcccctcccttgttcctccccctccctgccaccgggactgctgaagccagctcagccatcttgtgaccatgaggaagaaggcgacgtgctgagaatggtggagccgcctccctgggatcatcgccccagtgccagaccagcccaggtctcacctgcctccagacctcctagcaggggagatgagctcctaggagataaaccatggtgaaccggggtttctgttatctgtagtcaaagcccttgtacatcttgttaatcattaaattttaaagagagaaattattttgccaggggaaaatagcacagttcatttcagaataaagcttcaaagaaaataattctttctgaattgcgaggagaacagacaatgaaaataaatttcttgaaaaactgaaggctcaagttcaagttagcctggaagatctaactatggtcaatgatcaagaatacactgtaattaatctattctgtttactttgtctatgttcaaaaatttctatagttaaagaaaaacaaaacaagagacaataaagaagattcagtgagaggaagataaagggccatcagcaaatgacatcttccacgctggaggtggttaatctcagtgtctatctacatgtttggtttggttgttttaaaacaaaaatctgtacttatccttactatcaagagaggactgaatatcactcatcggttcagcatttactaagcaccagctacgtgtctggcacttgtcagagagtcctccctgctcagcctcaattcagcaggctgagttgttccgctcctgcagtgtggcacggaggccagcaggaggcgcggtagcggggcttcccgggacgccgccagaaagaaaggagtgggtaggtcctgatgggaatgaagctagagaaaaggaggaaatgtccgctagaagatggcacgccatatctggagtctgagctttaagaccttgatcgagcctgagggctgcagcttcagacttgccctgtaggtggcagggcggatgccaggcgcccagggacacgaggccacccaatggatgtcaagcaggaggggcagggacagaaaggccccacggctgcagacgcgggaggccccgagccggagacgctcgtgtgaacacaggcgctgctcctgtcacggccccttactcgccttgctgactttaaacagtctctcctcggtgttctccttgtcaaactgttcatcccagtttcctctgaaatagacagcattcaccagaaccagccttgtcaatggatccactgagcccggagagagcaactccgcaattttacctgagcggaagaattcaagaccgcattagataggggcggctgcggatccccgacacatcaggaatcggctggggccttctccttcagcagtcaagtgcacggatagagagttccactgtcccccaaatataaagggatacgtgtccttaaagcaaaacaacaaaatcttctggtacgaaaaacatcatcaattgaataaaacacacaaagtgaacaaatatgcgttaattatgcaggatgagttcctaacacatgagataagaagcaatcatgggtgcctatgacttaaagacaagaacttaaaggattatcaaaaaggtgggcagtcagaagatgttctttacaagcttaaagaacagttaggccagacacagtggctcacacctataattccagcagtttgggaggctgaggtgtgaggatcacttgaggccaggagtttgagaccaacctggacaacatagtgaggccttgtctcttaaaaaaaaaatttattaaaattagctgggcatggtggtgctacctgtagtcccaattacttgggagactgaagcaggaggaccgcttgagcacaagaattgatgctgtaatcccagcactttgggaggccaaggcgggtggatcacgaggtcaagagattgagatcatcctggccaacatggtgaaaacctgtctctactaaaaaatacaaaaattagcagggcatggtggcacgtgcctgtgatcccaactacttgggaggttgagataggagaatcacttgaacctgggaggcagaggttgcaatgagccaagattgcaccattgcactccagcctgggcaataagagcaaaactccatctcaaagaaaaaaaaagaaaattgaggctgcagtgaattgtgattgtgtcactgcattccagcctaggtgacagagggagaccttgtctcaaaaaaaaaaaaaaaaaaagtttaaattaagaaccacagatagaccagggcgtgacccagtgtcccacagcaatgcatggcaactgtagactgtgctacccaagagggaggcagcttgagatccacactgcgaattttttatgttacttgtgaaaggaaaaactatattaacattaacacactaaccccctcctcaaaattaaaacgtggattgatccagaagaggtataccaaacactgaaaggcatcacgggtacaccaaggaaacagggagaaatcagagagaacagaacacattgagcatttccaaaatgtcaaataatggcaactgatttcagaagcagattttttaagtttgcagttattcagagaaaaaaaaatcattcctgtttacaattgacagtcttgtgaaggaactgacaataaaatggattaagaggttattacaaaagtagaataacaatacattttcaccttctgtcttttcagctacccaggtgtttatgtgttttctggacttctctacggcgctgataaagtcaagctcctccatctctgcttggtagaatttttggcaggaatctctaaaagactaggatagacagagtgacataactgcctggctacaaaaatgatgaacaccaacggcctacttcttcattgcaccaagtcagaaaatctataattttatgattgacatacataatttacaaataaatatgaggacttaacctaaactacaacttcctagctttagctatatttaatcctagcttaaaaactaagtcaaggtcaggtactgtggcttacacttgtaatcccagcactttggggggccgaggcgggtggatcgtgtgagctcaggagttcgagaccagcctggccaacatggcgaaagcccgtctctactaaaaatacaaaaattagccatgtatggtggcatgcacctgtaatcccagctacttgggaggctgaggcaggagaatcacttgaacccagaaggcggaggttgcagtaagccgagatcaggccaccacactccagcctgggcgacagagcgagattctgtctcaaaaaaaaaaaaacaaaaaaaaaaaagcaaaaaacactaagttgaatcagtctctgaatatcaaacgaacttcaccaactgctggatcctttaagggagcagccatgcatcaaggagctgcctgacaagatgctgacaagacacttcaaaagcgtgaagtagatccaccttattgaaatgcagagaatttaaaacatattggcaggtgaaaagaaattacaaaagcctatgtatggcataatggcatttagagccacacgcttcctgctgggccccagcccccactacctggccacctttatttctttagtgaataagagcaagtatgacttactgagaggaaatcacaagacttttccccaaagagcctgttggccatcctaagcaagtactgcgtgccagtcttgttcacttcggtgagaagagactggaagccctggtggatgtctccaccaccgccacttttattgaaagaaagtatctgaaatcaaaaacagaatgaaaacaaatcattcctgtatgctctgacttcaggaaatggggcaaccccaaactcagcctaacaaccatccagacccttattactgcttaaaagatctatccgaggctgggcgcagcagctcacgcctataatcccagcactttgggaggccaaggcgggaggatcacctgaggtcaggagttcgagatcagcctggccaacatggcaaaaccccatctctactaaacacacaaaaatgagctgggcctggtggtgcgtacctgtaacccagctactcgggaagctgaggaaagagaatcgcttgaacccgggaggcggaggttgcagtgagctgagatcgtgccactgcactctagcctggcgacagagtgagactccgtctcaaaaaaaaaaaaagatccatctgattaaaggccagaagggtcttgaaagcccctccctgtaccctgtctgtgctggcatgagctgcaacgccctccacaaacccaggctcctgatgctcagtacttggagtctggtggcaaacaagggtgccaaccagacctcctgtctatacaaacacaggccgcccctgacatcagaaggggcagactccctcctgcccgtggctctggaatgcccgtgtcactggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtagagagagttgcttgaagaactgaggcctctagccgggcgtggtggctcacacctgcaatcccagcactttgggaggccgaggcgagtgcatcacctgaggtcaggaatttgagaccagcctgaccaacgtggagaaaccccatctctactaaaaatacaaaattagcctggcgtggtggtgcatgcctgtaatcccagatactcgggaggctgaggcaggagaatcacttgaacccgggaggcggaggttgcagtgagccgacatcgcgccattgtgctccagcctgggcaacaagagcaaaactctgtctcaaaaaaaaaaaaaaatcgaggtttcaggtgtgagagaggccttcttgaaccttccgggccaggtgtccactgaaacagctgcatgagtgacctgcactgcttcctgggagcagtcctgcctgctcaggccacggaatctgagaaataatcaatcattgttatttccagccactaagtttgggatggtttgttttgtggcaacagctgacacatgcagccatccagaagtggaattctgccatgaccaaaacctaaaacatgtggacttggccttggacccaggcagctggcagaggctggacggacaggacgaaatgactcctgggggctggagaaagggggctgtgtgtgtaccagctgaagaagtggaaagaaggtcaccctcagtgacagggaggatggagtgcctcccccgggaactcctgcatctggctaaggggtccaggaggaagctggcttctttttgctgcctagggtaacacatgggaagagaaagatgaaggaactgttccattttcaagcagaatttaaaggaactatttccaatccaggatgtactgggtggagaataaaaatgtttcttcttcccagcctttccagctggcaaaagattctaaaagagatggcctcagggcaaagatcaaatcccagacactggcctcaagggtgaggtccaaatccactttgttaaaccttagaagattcagacagcatcttatagaccatctggcaggctctcccatggcaccctgactcccaacccaacaaagagcactcaggatggcggtgggggtgcttttgtccagggaagcagaattttaagttgatagaaattccacagtggttttcaggcacttgtaacagcttggactaaaagagagagacggctcaaagtgcagggaggcctctgggtgcccacgttctacaggtgggaggtaggctgggagcgcagcaagcacgggccatttcttacagaacaggaaaggagctgccaagagcgacaccaggacacagagggcagagcacagccagggcagcaacggacaagggacaattctgggaagctgcagtggaggctcatcaaggaacaccctgcacccagggctgagaggtgaacaatacatgcctggctgggcttgggaattgccactgctccgtgacggccacgtgcctcccacgcctactgtgatgggctgcatgtgtcccctcaaatttacacactgaagtcccaactccagtgtctcaggatggaactgcatttgcagagagggcctttacaggggtgattaaggtaacataaggccattaggttgggctttaatccaataggactcatgtccttataaaaagaggagatgaggacacagacacacacagagagatgaccatgtgaggacacagggagaaaacagtgtctacaagccgaggagaaaggctgcaggagaaaccaaccctgcctacacctggatctcaggctcccagggaaccaccaggtccagagggcagaccacagcagtcacgggtggccccgaccagctacatctgtggtgtgcgcaccctctctcaacccctctcaggcgcggagatgcctctgcctttggcagtggggccttggcaagcaggacacaggcggggacgtgatgggtacttgtttcaagcctgtcttctgcgagcacttcctctcagaacccagccgccaggcctacggaagcccaggcaacgctgctgaaggaagcatgtggaaggccccagcggagaaggccacggagaagacgcccagcgccccgctgagcccccgctgacgcagcccacaagggacccacccagtgccaagtggtgcagaagcaccactcaatccacccagattcaacaaccaggaaagctgctaagctgggagagctggttacacaacaacaaataaccagaacgctactgaaaacatgtttagctgacaaatgccattctaagaaggctttacgcgtaaatgagaaaataaagactcctaacaaccaacaagcagatgacagtacccaaagatcatcacaggactcaacctgaaccttgtgactttacaaccatctacaaactcacgaacaagctaagccatgtgatgatgaaatcattcattcctctgaatcgggcgccccctctccaccccagggggtcagtcagggtgttgtccccagggtgctccagcatgggtggcatgcccttccctgtaaactcgccacccacaccctgcaatactgcacagtcatccgtctcgagcgatccctttgggatttggaataaggaggaccagctaacttgacagttaatagcaccatggctgccctgaagctgtacctgggccatctgtgcagcggtgtttccctttgcccccatgtagaccatggccagggcacaggacatgctcatgggtgagaaaaacacattcttcgagttgtctttacccagcgttttcaaaaggtttaaggcaaaggtgccatttgcttctgcgagaacatccatgatggcagacctggaacaagatttaaaatcagtatcacttaagcacagcttccacgcgactgcatctcacgcgccttaccgacagtcaccgccgatgctgtggttcagtgggcaagcagaaacacacacagaactctggctgtttctttttaggaccctccacattattttgtgtgtttctaatgttaagtgtggaaaatgaaagagttctatgtgaaacgccgccctgttttgtgaggactcctccctgcacgcctgcccgcacgtggagaaagtgggaaggaggcaccctttcctggagtctcttccttggggtggaattacagaaggggcactggcttttgcttctatgtttgtattctttggtgtgttttgcgggcttaaatgtactgttttaatttgaaaaatattcaaaatgatacattcactgacagttacacaagaaaagatggccaaatgtttttataatgagagagagaatcccatttctgggtagcaagagccttaaaaaaggatcaatcaagccacatacaaagatgcgtgaaagcctttcaaatgcctcctgacccttggatctccttctaggaaatccctgcaggtggcaaagccccaattttggaccacgcttggggacatcctgctgcaacaagccaggccttcctgcgcctgaactcacagcacactcaggacaccaccttgcctcatgggctgtgggtgcatgcccatctccaccttcacagacaggctcaggggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatcaatgccccactgcactacagggaaggtgaagttgacggaagtgaagctaagaagtagctgggcttgaaacgcagggcggatgcgctttctgagctgctgctcaagaagaagaatctgcagaatcaggtgagaggacaaggggcagctaagggccccacaggcagtcaggctgggaaggaggggatgcaggaatgcagggatgcggggcctgcctgctctgacacagttctcagatgtttaccaaatgaatatgtcccagtcagagaatgccagcattctaagacagtcccagtgactcacttgagcagtgagtgggaacccacggaacaaggaaggggagaagctggagcagacatttcctggagcagatgggagagggaaggaggtgcctactggaggccctgtgaggagatgctgaattaagcggctctccactgtgcatgcctttacatttggagctggggttggctgagcaagtgctccaaagatacctgggtcataatccctgggacctgtgaatgccccttacatggcaaaagggactgtgcagcacgattagattcaggctcttgagatgggagattatcctggattgttccagttgaccctaaatgtaatcacaggtatccttctaagagggagggagggggagatctcacgggaaaaagcaatgcaaagaataaagcaaaatgccactccactggccttgaagatgaagggcctcaagccaagaaacgcaaggaccacagctgcagtagctggaaaggcaaggaggatcctctggaggagcctggccctgcggaacccatttccaacctccaacctcagaactctgagaaaataaacatgtgcagtttagccacgaatccatggtcatttgttacagcagccacgggaaaccaagacaataactcatacacctgataaagcttgtttgctgtgcttgtttaaatattttgttttcaaactcttctttattcattacacagaatacttggggcactgggcactcctggcttgccaagcctttccaaacatattttaagattactaatttctaataaaaggacaatagaaagtacatattactaaaattcttctgaatataagggagtctttgatgatacataaataaatccaggattccgcagagccctgggaacaccagtataaacaaaagtagccattacacggaactgaagcaaaattgggcctatttttggttctttggattctagatcacaagaactgcccgcttatcaacttgaagagaaacaattggtaaaacagggaaacttctaggttaagaataagaaaagaggagatgccccaaagcaagaagcacagcctgtgaagtccgtgtctcaggactcaaagccagcagacaccctgacacgtggggttttccctggcctggggacatggacttctgtctttgtccccaagagggctcagcccacgtggagaggctgccaggtgagatggctcctccataaaccaaaaaaaaaagacagaggttaagtaccatgtcagctggccaggggaaggtcccacatgctcccccaaccccatcctagactattctaccgtcagcacacgttttcccctcaaatgctgaaggactcttacgcttttttttttgtagagacaaggttcttgccaccttgcccaggctgctctccaacgcctggcctcaagtgatcttcctgcctcagcctcccaaggtgctgagattacagccatgcaccacgcccagcctaaaggacttttaattcaaatggaaatgtccacctaagaaaggctaataataaaacactccgtctccggtaatatcccggagaatctgtttcaggcgctgatctttatatcagtaacttcaacaaagcaaagccacctttgtctgaagacacgcccactggggaggtgcctgtctggccagcccaggttacaccatctggggcagaggagaagtcggtgcacatgagtttcactgtgtcaggggatttaatttgaaatactgaactggagaaaccaaagcaggatattcggaggagaagtcagtgcacatgagttttactgtgtcaggggatttaatctgaaacactgaactggagaaaccagaccaggatattcggaggagatggcacgagtcaggaggaagacagggtctctagtcctggctctggtaccctgggcaaatcactggactcctgataccagtttcctctctgtatgaggaaaagcatataccagataatctgggttcccttccatctctaacattcaataattgttaataccaaatgcagaaggaagagcaaaaatgtagctcaattttcaaagcccacagtgaggtcagtaatgatattccatttcttagttgaaaacactgctgacagccgtgaaaggtaaaattctatctatgccttacataaaaattgctgagcaacaaagaaacaataaatcaaggatgtcctagagatttaattttcttagcagaaactatgttagtcattaaataactgaatatcctactcctgataaacacccttacgtcaaacagcaagtggtacttcccatgcttccttaacaaggtaagaattacctacttcagcagccaccagcacagctgatgatagaacattagtcccttaactccccaaacaggaacaagataaaaatatctgtcgtcccaaccttgtgtaactttgttcagatagttctggcaaaggcaaatacaactcatgaaacataatgagaaaggagattgtcagaaaggagacaaaatgagcacagttagcaaacaatttgatggtctacccaaaaagcagccagaatcagtaaaatactcttaaaactgaaaaataatggagtaactgggctactaaaaaaataggaaaaacagaccccagtagaaacacgtgcaaaggacattaacaaatttacccccaaaaaagaaagacaatagctaataattatatttaaaagtttcaacttcagaaaaaaatatcacttttttgatatatactatgtgctaggtccacactgaaagacccttaccctctgagatagctgctgagaacacctacgttttataagcaaagaaatcgggccttagctctttaagtaccatgtctccagagaacccagggcaacaatggcagaatgacggctggaagccaggaccgcatggctctgtagttcactctcttaacaccatggtgcacagccttcccaaaaagcaatggtggagagtacattaaagatgccttttcaaaccatgaaccttgcaaatacaaaaacaattcatgctaatactgacaaagacaggcaatccttctcacgccatgcaagtaatacggaggcagcagggacagagcttggcccgtacccactcccgtattttccatacatcccccacgccatcacacctgcccaccagaccatgcaaaccagggagggaaacaagataagccatgttccaccccaaatcttacccaagggagttaagcctgatgcccacatgcatacaggatcagaacgacgatcctgacctcttgccttgttgtattactaaaaccctctcctcaggggctcatctgccatgccctgatcatgacacatctgtgctaacatgatgttccccggtgcctgccactagcgtgtgtaatgctgctgacacacctcatgactatccatgtcaccctaaaacaccaggaacacctgtcccgagggccagcccgggaactcctgcccctgtgccgctgccctcctgctccagcataagcccattataaagccttgtctgggacactttctctgtctcatgtcaatttccactgcatgagaatctaagaacccacgatcagtaacaatactgtaaattggtacaccagtatttcctgagtatgatttagaattatgtcaaaaataaaagtaaaatacaataaagtgaaggaagaaaagaaaatgtcatggaaacattcatactatctgaattaaaaattccacttctaggaatttcactgaaggtaaaactcacaggttttgtacataataaaacattatgtacaacattatgggatataaatagggctaataataataaaaatcacagtaatgacatgggaatacacaagattacattaaaaaagatataaaactatacatacaatttaaatttatccatgtaaattaggaaaaaaggtaagtgtaggcacaatttacagacagaatagagggaaatactatacaccaaatgtttctaacggtaatttttatgttttttgtgtttttctggattttcacattttctatagcatataatttatggagggggttggttaactcttctttttatgaaattactatatatacattcagtttaaaaatcaggtggtgttaaaagagatgttataaaagacaacaagctccttctcagccctcccaactccccagaagcaatcacttccaaaccctttgctctttcttctggtatttaccaccatatttctacataacgtgtatactactatttttgacctaataactttatcatgttttattttatgtatgtatttatttttattagggtaggggtctcacgctgtcgcccaggctggaatgcagttgcatgatcacggcccactgcagcctcgaactcctggcctcaagcaatcctttagcgtcagcctcctaaagtgctggaactacaggcacccggccaaattctagacattatctattgccttcctaatctagaggccgagggcccggtcccgatccacaggtttgctttattatcactaaatagcattcgatgctaagccaggtggtgggatgggaacccatttcctttttatgtaatgctgatttgccttatattaatagtgcctttcccccctttccttagttttctatgtactatgtattttcaaattctccccaaatgttctacaggtcagtcaaaccctttcagtacttttttcatatgcttcgacacaaggaataatctaccagctgcattttcctctccctccgtctgtcaccatgctgctgagcatgcgcgactttcacgccgaagagaaatgttcatagacggggacaagtttccctactataatacatggccaatttatagtttggcaggctggtcagactaattttttttctcaaacacagcacattgcttacagggcaaagaaattattttttcttatttaagtgttgatgacatattttaatatgtctaattttttaatgctttatgcaaacttacaaattgcacaaaccttagtagacttttgaacttctacaaatctgataaatcaagacatataaatctagtaagctagcctctcctaagactttcaaacagtacaatgattacaaaacttatttctatacctgtacttatgtctagcaaaagttattcattaatatcacagatttaattattttatctttgttatattttcctattcctttcctaaggtaacactaatgcttattttaacagtttcctatggggaaaattaatcttatggggttaaatcctaagggatcatccctttctgtaaaaacagggtggggctccctggttcatggtctttgtgcatcaaagcagtttctcagcacagggcacacactctttgatgccaagcatatctgactagttagggcagctttgagctccaatcctgccttcactgagattttataaggcctcaaccaaacaccaaatttcagtgtcttgtagcctgatgtccttccttaaaatgaaatacggagttttcctctatctgagttgcatagaccagtgttgtatggtataacttggtctttttgttgaatgtttaggcctttaagttggtttttacaactactgtgtttgttagcccaggaagctataataactaaactttttccatagcaatcctagacacagtgcaaacattactgaattcttttgtgcctttttaaggctcatcttgtttgcctcatctgaacttattaatgagcttgggctttttacaaacaatatatttcaatttgctgatgtttttttttcttcttgttctaattggctggtgggaatctctttaaattagttactttccctccaaacacacttactttatatgcaggagtccccagcagatccgtctgtggtctgttaggaactgggccacgcagcaggaggtgagcagcaggtgagcgaacatcaccgcctgagctccacctcctgttaggtcagtggcagcgttggagtcttgtaggagagtgaacctacggtgaactgtgcacgtggtgatcttggttgcatgctgcgtatgagaatcgaatgcctgatgatctgaggtggaacagttttatcttgaaaccatacccccaactttatcagtggaaaaactgtcttccacaaaaccagtctggtccctggtgccaaaaaggttggggaccattgctttaaagcaacagcaaagtcttaccaaaccattttagatttttctagtccaaagactagatatgataggtgcacaccaccacgcccagttcatttttattttttgtagagacagggtctcgctcggtggccgaggctggtcccaaactcccggcctcaagctatctttccacgttggcttcccaaagtgctgggattataggcatgagccaccaagcctagcttgggaaaaaaatgtaaggcacttgctgatttcctccagactggctctttgttctctttttctgtcaagtacaaaactcttagactgatatcatctgggacttctcacctttctccaggctgtgacacacacagaaaatgatgtttgtatgtcactttggggccaggctactcaccccaaaggtgaccagtgcagagctccagccacccagactcctcgagttggagggatctgttaacctgcccagggcacaacacccacacacaagttagaaagttctgctctggaagactgaaactggaccccttccttacatacaccatgtacaaaaatcaactcaagatggattaaaggcttagatgtaaaagccaaaactataaaaaaccctggaagacaatctaggcaataccattctggacataggaacaggcaaagatttcatgacaaagatgccaaatgcaatcacaacaaaagcaaaaattgacaaataggatctaattaaacttaagcactcctgcacagcaaaagaaactatcaacagagtaaacagccaacctacggaatgggagaaaatattcacaaactatgcatctgacaaaggtcaaatatccagcatctatatggaacttaaacaaatttacaagaagaaaacaaacaactccattaaaaagaaggcaaaggacatgaacagacacttttcaaaagaagacattcatgcagccaacagccataagaaaaaaggctcagtatcactgatcattagagaaatgcaaatcaaaaccacaatgagataccatctcacgccagtcagaatggctattattaaaaagtcaaaaattaagagatactggcaaggttgtggagaaaagggaacacttacacactgctggtgggtgtgtaaaacagttcaaccattggggaaagcagtgtggcgattcctcagagctaaaaacagaactaccattcaacccagcaatcccattactgagtatacaaccagaggagagaggaatagaaatcattctcccataaagatacacgcacgcgaatgttcaccgcagcactattcacaatagcaaagacatggaatcaacctaaatgcccatgcatggcagatgggataaagaaattgtggtacatatacaccatggaatactatgcaaccataaaaaagaatgagatcatgtgttttgcagaaacatggatggggctggaggccattatccttagcaaacacacgcagggaacagaaaaccaaataccgcatgttctcacttatgagtggaagctaaatgatgagaacgtggacacaaagaggggagcaacaaacactgggtcctatcagagggtggagggtgaagggtgggaggagggagaggaaaaaataactattgggtactaggcttagtacctgggggatgaaataacctgcacaacaacctgcgacatgagtttacctatgtcacaaacctgcgtatgtatcctgaacctaaatagaggtttaaaaggttaaaaaaaaaaagaagaaatcatataaatgaatgttctcttctgaccttattccctcatttacacttttcatcatgatatttgattccattttgccttctatactaattctttggataccacaattatagtttattgagtcttccgttccctgcgctgcctatctctggggtccttttgttatggtggctggtgtttgctttattttatttaggtctctcttttgtacctagactttccaaacattcctaacaacccttggatgtcagtacatagttaagaggaaaacacaaacaatgctggaagttctgtttacatggaggaagttctgtttacatggacaggacatgtcagctgggagcttcactgcagtgtgctcaagggatcagcagcttttttgtccgggaaccagcaaatgggagaactcttcggtgtggctatcggtggtgttctggaaggagatggggtggaagcagatgggggtcggggggcttctactggatctgtaatcccctcacgtccccactgcctcccccacagtgcctgcaggaccctgagtttgagcattttcattatcacttcgcaataatgcataaacactgaacaattaatcataaaaaagattggagagatccaaatcctaaaaggaaagaaaaaataaatccacatttaaagtttaccactcaagatactccaaatatcaacaaattataaacaatctagtgagatttttctatcgagggctttctgttatcctttcagcaaacgtgtgagtaacaaggatgcctgtttcacagtcacgttgcaaactcaagacctgtcaatggctttttaaggacctacttctttagcttcagtaaataagatagctaagtgtccttcatatatatatgtgaatacacatgtatatatgtacatagacaaatatttatgcaaaattaattgtttcaaaatttaaaaactataccatttaaaaataaaaaatgatatttaatcacagacataaaaactggatattaaagtcttattaatgaacaattttatgtattttttaaacaagcctaacaaatctatcctggcatcactttttttttcctgtagcatcaccagtaactgagcaatgttcacaattgattttattcaactaatcaagtcttaatttttttttaggtgtcactattgaattgtgcttctcaacttctattaaggatgcctttatttcctactaaatttaaccatttaaagactggtttaatggaaacttggacttcctgctttgtccctctgtttccttgtgcagtgtgtatgtgtgtgtgtgtgtgtgttgtgtgtgtatgtgtttaatatatctgagcagcctaacatataaatgggagttaaacattattttcaggctaggcgcagtggctcacatctgtaatcccagcactttgggaggccaaggcgggcagatcacgaggtcaggagtttgagaccagcctggccagcatggtgaaaccccattgctactaaaaatacaaaaattagccaggtatggagcccgggaggtggaggttgcagtcagccgaaatcgcaccactgcactccagcctggcaaaaaaaaaaaaaaaaaaaattttctttctttggatgccttggcttaatcccaagtgcagtaagcctggaaatgtaaggtgtgtggtcttccctgggaccgtacaacatctgcttgggtgcccttattattacatatgtggaaaagaatgttggttctattcatgctaatttcactctactgttactggtccgtgttaactgtttcatgctgaattgtaataaaatgcattggaattggccttaacttaaaatacttagtttacatagtcgagtatgaccaaagtacttttctctttggtggcacatcacaatggatgcaattactcagatacggtcctgaaatgagaacaaacgccatctatgctgataacagcagtcactggtgttaatcccagcacacataaaagccccagcaatacaaggccggcccaggaccttaactagaaggtcactgaacacatcagatctcatcgcatcaggcctgacccccaccagaaaggatgcaggcagctgcagggctgtcattaggcacgagagcatcccagaaagcaaaagtgcccaaaaaatggactcagatgccccctcgcatctgagtattcctgacagcatgtgaacattaattattaattttctgtacctcagttttccgaagccaatctttaggacaaaaaaaaaaaaaaaaaaaaggaagaaaataacttaaatgccaatttgtagttaaagtttcctctttgccttgaagacatcaaagcctgtaatagtttgcctgtagggagtttaattcaaacacagagcggtaaggagatccgggctggtccacacgatcgtctccacaggtctgggcgacctgaaagtgctgcggattggccaagcccagcacggccagtccagtgaacacacgcagggggcccggatggcaccgtttggcgccgaacccctcggcctctctccgcctcccgcccggctcctaacacccggcgccccaagactgagcacgcgtcctccgggtcgcggagcgggcgaggggtcaccgaggccgcggggccgaccggggtcacctgtggcccgggaggctctgcgccgcccccatcccgcgccggccgcctcttccgtgggcgctgggcctgggcgcccggggtcctcgggtccgcggcgtcaccggccgggctcgcggccacgcacgactcacccggccgcgtcgccgttctctgccgctgcgaggctccggaagggaacccaagccggacgctcgcccgggcccccgccccgctgggactgctggggtcacagccccgcgcggccacgccccattctcggggctccagcgtccccgcgcgccgtcgacccacgcgcgttcccggccccgcgcgacccccaccctgcccccctccccgctcgcgcccccggctttcccgactttggagcgacaaacccaagccagcgtgtccgagcggctcccaagccagacacgtactccagagcggggagcgagcgagcagaacggcgggcagaggcgccggagccgccccggacctcaaatactcgcggggaggcgggcggagtcccgggtctcgagctaccgtcgcccgtccggagcgcgaagggagaggcggggcgggacgtgcgggtcaaccccacccgccagccggaggggccgcgagtcctgcccggaggccttgactttgaccacagtacagggccccaccagcgtgtttatggtgcctctgtggagactgaatgctggcctgtttccagaaaagggccggctcctgatacacggccatccactggggagtgcagaacacgcatttaaaaatgagcagactagatacaggtcacaaagactttgctgatgaaacagcttgcggcaaagaagccagccaggggcgggcgcggggctcacgccagtaatcccaacactgggaggccgaggcaggcggatcactggaggtcaggagttccagaccagcctggccaacatggcaaaaccccgtctctactaaaaatacaaaaattagccgagtgtaatggcgcgtgcctgtaatctcagttgctggggaagctgaggcaggagaatcacttgaacccgggaggcagaggctgcagt

SEQ ID NO: 233 - DNA, 24007 bp, Homo sapiens; identical to SEQ ID NO: 232

SEQ ID NO: 234 - DNA, 24007 bp, Homo sapiens; identical to SEQ ID NO: 232

SEQ ID NO: 235 - DNA, 3205 bp, Homo sapiens
agactactgacttggaccagcaggggaatggctgtgacaataaataagattgggaaaacaagaaggtgagcaaatttagaggagaaaatgaatttcatttttggcatggtgtggaaggctcgggagagaggtctaggcaccagatgtcaacgtgaggtgaaatggatatagctgaagtcaagggtgtggtgaggttttgcagggagagcagggacctccagcaaggccagtgcataagggagaatagagaaaaaaagaaccagaaaaagacaaggagaggccagagaggtgtggaaagaaccagggaagacagttattcacaacaaacaaaagagggcagagttttagagaaggaactgagcagtttggggctccaggtggggcaggagtgggtggccacggttgaggggcagtggccttcaaattggtctgggtaggttctaatgggtcagattggtcagtcctttccaggacactgaaggctgcagaggtgtgactggatgctggtggagggatgcatggcggggaagctgagtcagatcctgaaatcctccaagcatgcgcctgaaatgaccaagggaaatgaaggcggaggctgctgtcgcctggtggcctgggaagggccaagagccagggagctggagggaggagagaacgtgcgacctcagcacggagcactgtaggggaggcggggctggagggagatggcgccgcgctcccggatgaacagagaaagcgacagggtgagtcgcagggcacagtgtgggatgagtcaccgacagcaaggcatggactccgggaagaaggggagacgagccgggaaagacttgcatcggggatgtgagctgagctgcacccagacaaaagcggctcggggctcctgaaagcagcaggcaccgccggtcctgccaaggggctacttcctgcgcggagtaggagagtaggagaccccaggccagtcccaatccccggcccgtccgggatgaggggggctgcgggagctgcgggggcctcctccagggaggacggttgcagggtccctcggccgccgcccactcccgggggcgttccttcctcccagctgcgcccggagcgcctgctgcctggcgagagcccgcccctctgcaaccagcccgctgcagcggagggcgcctgggtgccctcggccgagccagcagcccacggtcggcgccgcactgtcccctggtggcggagcgctcccgcgacccggctcgccacgcctgggaggggtccaggaggacgcggctgggacctgggggctctcagggtggggccttgggggatgaggctggggcccgcgggaaaccgggctggggcgaggaggctcgcaggacttcctgccacagaatgtttcgatgctttttttaattctgcaaatgtaagcctttccactttaagtccaagctcagcgcagaggactgttctataatacatacaatttagtttaaaaatgttgcaaatgttaacatgtgtcacaaactcaagcaatccagtattatagaaagcaaagaatgaaatgtgctgcttctttctcccccagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttgtgagagctgggaagtttcagaggtagggtgtctttaatgaaggggctgggcattaagagcacgggggggaatattcgtgctttccttgggaaagaacggagatttttcccggaatcaagaaacccctttttttctgtcccttcttggtctcttccagtcgttgtcatggcgacatgttgtttagcatgagaacaggatgatgataaagccagaggctcttcagaggcgccatcttggatttcgccagcttcagctggtttcgtcctaagaaggaacttcgaaacacaggcattctttttcctgaaaataagcagagttacagctgagtaggaatttagctctgtcccatatgctatcgcattgggcagcaaaagcagggtggggtccagcgaaatcagcaggcactgcaatgagtaacatacccagccacgtttatgcagcatttttacgaaaatgaaaccatactacctgtaaaggaagatatgctaacaaacaacaaaactggcaggaaccaagattcctactgacactacccttagttttaattttccctgacaacaaatgaggttaacagagcataattatctaccgtgaccccttcaaaaagacaggctgtatacatttgcactaagagaagaaatcgtgtaatgtcagcaaatttcccccacttaaagcttctctatttaaaaagcttcacgcacacatgcacgcatatgtcttcaagatgaccacaatttattttgcagtcattctttgcaccagttcccaatttttcccactagcttgcaagctccgtgactcgaggagaccgggggatcagagtttgtttttgcggagaagtgagtcctttatgccccaaatagtgactgacatagagaaggtactcagtaaacactttttaaaggaatgcctgcctgactgaagcttaatgatgtgaggcttctagtgggataccctaccttgttttaacctgaagtgactcttccttagctaagagagccagacggactccatcgtgactccttcactcgcagccccttacccacccccttcctcaaggacttaacttgtgcaagctgactcccagcacatcaagaatgcaattaactgataagatactgtggcaagctatatccgcagttcccaggaattcgcccggttaatagcacccagagcccctgcgtttgtgtccggttgataacgcccaaagcccggcgtccatcaccttaggatagacttaaagcctctgcacctggaactgtttactttcctgtaaccgtttatccttttaactttttgcctactttacttctgtaagattgtttcaactagactccccctctcccctgtctaaaccaaagtataaaagaaaatctagctccttcttcggggccaagagaatttcgagcgctagctgtctctcggctgccggctaataaaggactcctgaattcgtctca

SEQ ID NO: 236 - DNA, 3205 bp, Homo sapiens; identical to SEQ ID NO: 235

SEQ ID NO: 237 - DNA, 19928 bp, Homo sapiens
gggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaaggtgagtgatcccctgtcggggaccgggggacttgggaaggacagttcccggactggacggccagaacgctctcagggatttcagctggccggccatatggccctgtgggtcgtcgcgcccgggccagggaccattctgtacataggatcgtgcttggctctcacggaacgcgcccacacgcagggtcccggtgtcgaatcgtctggtggaatctgccctcaaccctatggagcgggtgctggtatcatagtcatattacaagtaggaatcagcgggcccaaggtcagtctgtaaagggggtaccggggtttaggcccgtgcgctgcccagcgctgccctgaaggcgcggctgaaccactggtttgcgctgcctttgtcaaggacattgtggcactgtggaaaaaatgaaaaatcagcttctctaacctataatctctctgggaaaaaaaaaaatcagcttttttttttttccccgagacggagtctcactctgtcgcccaggctggagtgcagtggcacgatttcggctcactgcaacctccgcctcccgggttcaagcaattctcctgcctcagcctcccgagtacctgggattataggggcgtgccaccacgcctggctaattttttgtatgtttagtagagacgggtttcatgttggtcaggctggtctcaaactcctgacctcgtgatccgcccgcctgggcctcccaaagtgctgggattgcaggcgtgagccactgctcccggccctctttttcttttttcttttttttttagaagagtctcactctgttgcccaggctggagtgcagtggggcaatctcagctcactgcaacctctgccttccaggttcaagcgattctcccccctcagccccttgagtagctgggattacaggcgcctgccaccatgcccggctaatttttgtatttttagtacaggtgggagtttcaccatattggccaggctggtcttgaactcattcttcttcctttctttttcttttttttttttttttgagatggagtttcactcttattgcccaagctggagtgcaatggcacaatctcagctcactgcaacctctgcctcccgggttcaagctattctcctgcctcagtctcccgagtagctgggattacaggtgcgtgccactacacccagctaatttttggtatttttagtagaaatggagtttcaccatattagtcaggctggtctcaaactcctgacctcaggtgatccgcctgcctcggcctcccagagtgctgggattaatgaaccactgcgcccggccaaaaatcagcttctttaacctttaatctctgaaaaaataaatcagtttaacctttaatctccgaagatcacagccaaagaaatacatgaaaaggaacaagtattaaataatatatacttctagctgtgctgtttatagttttgggaaaaaaatggaaataacctaaggtcccagaaataggaaaatgggcacaaaagggtatgcaggcaatggtttagctgccgcatgaatacacactgaatacactgtgagatgttgtctgttagaatgcccagcacggggactgtccacatggaaagaggcacaggaaaaaaagtgaaaacattataaaataacttcttaaaattaaataatgtacacgtcaaaaatatcagagcccacttgacctggtatatacagtttaataaccacatggctcttttttcctgtaggcctgggtaggtgcatagtttctaaaaagggagagaactgtcactgctgtggatggggtgccaagggaagtgcctggggtcaagtgaacagtgacacaactgcaagtcaagagcctgtgttggagtctttccccactatttcaaatagtatagaaaatagagctgagtcactcaaatagagctgagttagtcactcagctcttggacctcagattcttattcttaaccgctagggggatggagacagaagtcacaaactcacatgccaccagccatatgatgtaaacatgtaaactgggccaaggaatacaaaagggagtggtgagctggggacactgaagaatggatgccctgtctagaggagtgaaaatgaagcatttcatacaaacaacatgatttcgggcaatcactttgggaatcaggataaggtgttcccccagtctgcagaaacactggcaacatttacaaaggtaaatcatttcatatcactctattttctttttcttttttgagacagagtcttgctctgttgcccaggctggagtgcaatggcacaatcttgactcactgcaacctccacctcccaggttcaagtgattctcctgcctcagcctcccaagtagctgggactacaggcacatgccaccatacccggataatttttgtattttttagtagagatggtgttttgccacattgaccaggctggtttcaaactcctgacctcaggtgatccccccacctcggccccccaaaatgctgggattacaggtgtgagccaccacaactggcgatcattccatattactctccagcttaagaggctccaagggctttctgtcaggcttagaataaaatcctcacccctaccctaggaggggtcaggtcagacccctcccacctccctgactgcatctaccaccatccactctttttttttttgaaccacagttcagccaaacaggctttcttttttttcttttactttctcttttttcttgaaacagagcctaactctgtcacccagtctggagtggagcaatcctctaatctcagccccctgagtagctgggattacaggcatgcaccaccacacctggctaatttttaaaaatctttggtagagatgggatctcactatgttgcccgggctggtctcaaattcctaggctcaagtgatctcctgcctcagcctctcaaagtgctgggccttctgcttccctgggctttgccaggcctccctatgcattgtgatagccaaagtttgctttctacaaagtcacctccaggcagtgactgtccaccagggcactgtagagcctcccagctaatgatgaagtcactcactctcctctctttttcctttaagataatccctttccagacccgccattttggctcaccctgtaagttacagccccacttctcactgccaagtgtgggtgtcactgctggctcagggagcatggatcctgtaaacttgcctcatcgggaggctttgaggagtgacccccaggaactagacaagtaacttgttcttcacaatcactgccctcccaagaacatccaggatttcagcctcagtgctaagacaaccatgtctctccctgacacatgctcgctgctgagaattctaggaaaagcagagggctgtgcaggcgcccctgcccctaggctaggagagctggcaaatgcctggagacccaaaggcctcatcctcagggcggccaactcttctgttttagtgatatacagactatcttttattgtgatttatagtgcaacttaccggttcaaacaatactacctgtattcataaactttctttttcctttccttcctcactgcccagctttaggttcattcttgtaagtgttgctggtgtcagaataggaacctccctgcgctttgaagggatgaatgtgacctctcccacattctccggtgctgtgatgtaccttaaacacagcaaggtacttggacacaaagcctgtgcctggagcactttcagacagacagtgcatggccctcgctacagactcagtgccattgtagatgtttctgcatggaaaatacataaacacaaatatctgcagttgccaatccaccaccatcttgcagccccaagagagccccgggaatccaggttcctttggtatttctgctccctgcccttggtgcatagcctccatccccaggacgacaagaaggctgactgagccctaacatcatcccacagtccagctgggaagagagccagcgacaaagccagagggagctagctcccacacctcccagccccagctgagttcgcttcttgagggtatttcttggaagccccgcctgtgacttctgctgacacctcactggccatctcaactgcaaggcagcctaggaaatgtagtgcttacctgtacacgtggattcctggaatcaattcagggtctgtccttggggaaccagagtggggatattcagtcactaaagatgcaggttcccagctgtccagtgaagtcaagcgaatggggaaggatttgaagtcacctttgggtgtttggagtgatcagagctgtctgccctcttggggagtgacagtgccccactctgttaagtcccatgcctgcccccaactcagcttcagccacaatgatgtagcctcttttcctttccatccacagggcacctggcctgggtggagcccactcctcagcacccacctcacttcttgcagtattctgcagaccccagccctgtgcctgtgctcctggacagctggagataaggagtgggccctggaagatgctcattcaggccctgctcaagattccagtcctggtggggataagcaccacttttgtgtgtctctgtgctttttgttttgctgtaaagacacactgataggttcacgttgtcgtttggacacaacatgcgcgatgcgtgtcttcacactaagccctagtcacactctctgcattgtttttttatcccattttttcctactgtggtacagaacatctcacataaaattgaccattttaaccactttttttgtttgtttgttttttgtgtttttggacagagtctcgctctgtctcagcctcccgagtagctgggattacaggtgcacaccaccacgcccggctaatttttgtatttttagtagagacggagtttcgccatgttggccaggctggtctcggactcctgacctcaggtaatccacctgcctcagcctcccaaagtgctgggattacaggtgtgagccacggtgcctgacctcattttagccacttttaagggtagaattttctggctgttttcattcatgtactgatagacacttgggttgcttccatgttttagctgttgtggaaaatgctgctttgaacatgggtgggcaagtggttttcaagaccctgctttcagttttttgggttcagagtaacgaatggaattgctgagtcatatgttaattctcatttttctaattgtaatttttgggggcacagcacctctccagcagcggcagcactcgacctttccccagcggtgcacggggttccaacttctccgcatcctcacctacgtgtgttttgttttttggtagtagtagccattctaatgcgtgtgatatgggatctcattgtggttttgatttgcatttccctaatgattagtgatgctaagcatcttttcatggcttactgaccattcatacatctttggagaaaagcctacacaagccttctgcccatttttgcattgagttgtttgctttgttgttgttaagttttatctgagctgtttttttatggtagggagagtgggtttgttggagtctccttgtatctcccagaaggaagccagaatttcagagatggccaggagggggtgaggccaaaggctcccctggggagaactcacgtttttccagagccccattgtgtgccagccaccgcacatagcaactgtctctctctcactcttctgggccatgctgtgactttgttgatgaggaggttgaggcacagaggggtggagggatgtgctgcagggcccacagctacaatgggcagagctggaaattgcaccaagtctgtctgatgcgggggtctcctctgctcctctggcctccgctgcatccctggagaatctctgagacttctggttagagcctgggtctaagccaactcccattattttcaagtgaggggaagggccgacaactgccagtgctggcccaccagagtctggcaccagccgaggagtgcacgcacccattggtggtgtggcggttcactgatcccccagccttctgctcgatctacggggaaaactggggaaggcaggaaggccaaggaggctcaactcctgcttcctaccgtggctcatttcctgggtcctttgctgtatgactgtctggatggaaggttcagagtcctctcaaaaaaggaaaaaagtatgggttttgacatcctgcgtggcttgtcctctgaggcctaaatctccagaagattcctggcctctcttgagaggtctttctctgatgtgtttgcgtgtctgtcaggaagcagcagtgatgcctagatgtggtacattcgacctcacctatgcctctccccaccccctctgggttcgttttgtcttccagattgctggactcgctgaagagagactacgcaggaaagccccagccacccatcaaatcagagagaaggaatccaccttcttacgctatggcaggtaatgattcactattgtggagtaagacttttttttttttgagatgggattttgttgtattgcccaggctggtctcaaactcctgagctcaagtgaccctcccacattgaccttccaggtgggagttagactcttaatcagaaattggatacattgttgtaaaaaatccaagccacgtggaagtgtataaactatctggaattatcttgttttctatgttctcacttgtttcattgttcctttcgactccctccagaatttaggttcctcaaaagtggggccctgcctatcctgtctttgctgtgcctccaggccctgaaattctccctgggctgtagcaggggctcaagtgaatgaaccccaggaggcatcttgggtaaaaattcagtacgattctatctttgcttttgcaactgcttatcatgcacatatacatgaacatgcaatctctcaactttttaatttcacctaacgatataacatggagagcctttcgtgttagaacgcacaggttcaccttactctatacattatggtgtagattcggattttcgcccttggcaccactgacattctgggccagataatcctatgttttggggggtcatcctgtgcaccctgtttagcacctagcaccatccctggcctctgcccaccagatgccagtagcacccctcccccaccggctgtgacaaaccaaaatgtctccaggcattgagaaacgtcccctagcaggcacaacactgccccagttgagaaccattggtgtaggtatttcatttgcatctattctcctgttaagcccctaagtatagttcctttattgaaacaagagtctgagaaagtaaaattaaaatgttaaccatgaatctaacttatggaattcaacctttgtagccagctcaatgccctgaaacccattgcttcaaactgatacgtgtatcttttccttaaagtgtcattatgaaaaatttaaatcaagagtttaacatcttcttaaaggtgaccagggtaaatttaattaagcaaatcaccaggctgcctcccagacgaagtcagtatataagcctggagactctttccaatgaggaaaatactgcttcagaagcccctggtgtgaacgatactgccagtgccaggagggcctgactcttcctagagtcctctttgttatcagcatcaccactgaaagatgggctccatgtggccctgccttcccatgagaccagcgggtctgattcctcatgttttgtttaagtgtcagatttgatggactgggggagatggaagcagaactgtgccacactgaaaggtgcctgtagctgatatctgcaaatgtagggttagcatggaagactaattccagcagttctttattttggtgttagggagctggtctaaaccttcttacagaggataaccaaattaggttgggcttttaaaagatttagtggtggtatttttgaggagatataatttgacccattgtattgtgatgttgagctatgaataactggatttttaaaatgcccattgctttaaaactgccacctattagaaagtttggtatttctggggccaggtgctgtggctcataccagtaatcccagcactctgggaggccaaggtgggcagatcacctgaggtcgggagttcgagaccagcttgaccaacatggagaaacccggtcttaactaaaaatacaaaaaattatccgggcgtggtggcgcatgcctgtaatcccagctactcaggaggctgaggtaggagaattgcttgaacccgggaggcagaggttgcagtgagctgggatcgttgctccagcctgggcaacaagagcgaaactctgtttcaaaaaaaaaaaaaaagaaaaagaaaaaaggaaagaaaagaaagtttggtgtttctggccaagtgcggtggctcatgcctgtaatcccagcactttgggaggccaaggcgggtggatcacttgaggccaggagttcaagaccagcctggccaacatggcaaaatcccatctgtactaaaaatacaaaaaattagctgggcgtagtggcacacatctatcgggggaaattcagccagatattgggcgaaattcacccccaatatttcacgtaggttcttttctatatttcctaagtgtcggccggtctgagaaataaacggacagagtacaaaagagagaaattttaaagctgggtgtccaggggagacatcacatgtcggcaggttccgtgatgcccccaagccgtaaaaccagcaagtttttattagtgattttccaaaggggagggagtgtacaaatagagtgtgggtcacagagatcacatgcttcacaaggtaatagaatatcacaaagcaaatggaggcagggcgagatcacaggaccacgggacggggcgaaattaaaattgctaatgaagttttgggcaccattgtcattgagaacatcttatcaggagccagggtttgagagcagacaaccgatctgaccaaaatttattaggcaggaatttccttgtcttaataagcctgggagcgctacgggagactggggcttatttcatccctacagctggaccataaaagacagctgccgccccgaagcggccatttcagaggcccaccctcagggacgcattctctttctcagggatgttccttgctgagaaaaagaattcagcgatatttctcccatttgcttttgaaagaagagaaatatgtctctgttccgcctggctcaccggcagtgagagtttaaggttatctctcttgttccctgaacattgctgttatcctgttcttttttcaaggtgcccagatttcatattgttcaaacacacatgctctgcaaacaatttgtgcagttaacacaatcatcacagggtcctgaggcaatatacatcctcctcagcttatgaagatgatgggattaagagattaaagtaaagacaagcataggaaatcacatgggtattgattggggaagtgataactgtccatgaaatcttcacaatttacgttcagagattgcagtaaagacaggcataagaaattacaaaagtattaatttggggaactaataaatgtccacgaaatcttcacaatttatattcttctgccatggcctcagccagttgctccattcggggtccctgacttcccacgaaacacacctgtagtcccagctagtcaggagactgaggcatgagaatcacttgaacctgggaggcagaggttgcagtgagctgagatcatgccactgcattccagcctgggtgacagagtgagactgtctaaaaagaagagagagaaagagacagaaagaaaagaaaatttgatatttcttagcttcaattactatgatgcacctgaacattcaattttcatcttagtcttcattgaatttaacagagagaggttgttcttcaagaggaactgtttcttatcctgatttaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtgagtcatgggataaatgctctatttataaaaaccatctttatgttttttactttaaaaaatgttgacttccagctgcaaaatggcattatagaagcaagctagcttcactttccaaaaacaaatagatagcactgggattatcaccagcagtatcccagaagtcaaatatgaagatgaaatagttcccaagaccacacataagtgaaacaactccaagcagacggtaagagattggactatcatatccacgacacccctccccacaaactacccagcaccagctgtgtgggaaatttcctcccaagtcacaggttctacactggaaaagagatcaagggggacaatcagcttctcaattttctggggttcccagaaacaggcaggaaggagacctgttcctgcctcaacccacaggaagcatcaggagtgcctaaagggagaaatatccctgacaacagccagagacaaaggagggagatgggaatattgtccccagccctggaaactctgatctgtaacttagccaaaggagatgccaaaccagagtggctgttcagcagcaccacactgtaggaggtacattctgcaggtttcctgggcatgagctgctagccagccttcccacactaccatgctatcccctttggaacctctcatattcaggactggcacactctgaacagtaggttactagagctgaggcaaacgtgggcataaaccaccatctagtgccaaaaagcaggtggtggcttagtagaggaaaaaaaaaaaatttaataagaaagttgcaaagactttctaagcaaatatatgtaataaaaatgaaaacaagtcagacatagaagactgaaataaatagatgtcatccacaagaaacaacagtaaacagggaaccatgacctctccacacagacaaagcaaggaaccagtgactgaacctaacgagacggcactgtttggactctctgaccaagaattcagaatagcacttttaaggaaatgtggtaatcctcaagatcacacagaaaagcagttcagaaatttatcagttaaattttacaaagagattgaaataatttttaaaaaatcaaacagaaatcttggaactagaaatacatttgctgaaaaattcattagaggctctcaacagcagaatggatgaagcagaagaaaaaatcagtgaactcaaaggcaggtgatttgaaaatacacagaggagaaaaaagaaaaaggtatggagatttcttacaaaatatagaaaattacctcaaaagaccaaatctaagaatgattggtgcttaagaggaagctgagcaagagcaaggcatagcaagcttattcaaagaaataataacagaaaaattttccaaaacttcagaaagagataaatatcctggtagaggaaggtcatagaataaacagatttgactcaaataggactaccccaaggcatataattattaaactctcaaaggtcaagaacaaaaagaggatcctaaaagcaaataacatgtaacagagctccagttcatctggcaacagacttctcaacagaaaacatataggccaggaggtagtgggacattttcaaagtgctgaaagaacaaaactgtcaaccaagaatactgtacccagcaaatctagccttcaactctgaaagagagagagtctttcccaaacaaagaaaagctgagaaaatgcaccaccaccagacccaccttacaagaaatgctaaagggaattcaataagaaagaaaaacactaatgtgcaaaaagaaaacatttgaagatgtaaaacccactggtaaaagtaagtacacagaacactctaatactgtaattgtgtacagtccactcattactagtattaagtctaacagacaaatctatcaaaaacaataatcactacgtgacctgttaagagccaaagataagcaatataaaatatgtaaatcaagacacagatactcaaaaatgtggaggtgagcatgaaattaaagcgtagagtttatttttttagacctgtttggcattgaacaagacatccagcctctcttgggtgtcagtttgctctctggtaaattgggaaatacaccagtctcaccagttgttatgaagaaaggtgatgtgtgtagagcacagcacctgctaggtagcaagtgctcaatcagcagccctcccagactgcttctctttccctagctcggacccagggtgcagcttctggtcaggttgcagcaaatgtctttgacttgtctgaggagtccggtatacacagtgctactgggatggttgggatgggctgtggatgcccacctaggagtgagaatgtttggcctcttccccgacaggtactctttctaatcctgaggttttcaattatggagtggaaacccacgaagcctacaagcaaaggtctctggctagcgacatcactgatgagcagaaaaaggttcgggaggctgacctagtgatatttcaggtttgtttttctctaattaatatattgaatcagattcatcttatgtacaaactctttctgaatattgagttttgtgctgcttctggaagtggcatcaatgttttgagcacagttgcacacttactgagcaaatattgtaacctggttacaacacctagttacaacatttcacctagttacaccacttcacctagttacaacacttcacctagttacaacacttcatctagttacaacactactttaaacactgtacgtagatgtaacactactttttttttttttttttttttttttttgagacggagtctcgctctgtcgcccaggctggagtgcagtggcgggatctcggctcactgcaagctccgcctcccgggttcacgccattctcccgcctcagcctcccgagtagctgggactacaggcgcccgccaccacgcccggctagttttttgtatttttagtagagaccgggtttcaccgtgttagccaggatggtctcgatctcctgacctcgtgatccacccgcctcggcctcccaaagtgctgggattacaggcgtgagccaccgcgcccggccgatgtaacactactttaaacactttacctaattgggtaaagatatccacgtagccaatatcactcactccaaatcccgactgccatgtaaataggaatgaaggatatttccattattccagtggtccaagaatcatctgaaacctgccagtcttgttgcttcccttctcttcccgttcctgccctgagacattctggggctgcttgagaaccacatttatctgcacaaatgtttatcagggtaaatcaggccaaatgcatctccttaaatatcctgccttaaatatcctgatcattaagaggaaaatctctggtttctaccctctcagtggttgcttcacccccagcccagccaccttcctgtatttgttcacaaggaggtgatgccactgcagagtgaactggcccagcaaaatgccctccaggagtgctgactcatcaggccacttcccgccactgcaaggaagatgtgcaggcatggctgtggctgtgtaaacctggcagcagagtacgcacatgagctttgagggaattgttgggtgacagaaattcctgtccaactagaaggaaaggggaatctattataagggctctggtcacttgggcctcctggatcccaaggacagagctgtagctgctctcgtccacagattcccatctgctcctttctgcctcttggctctgttctctctcactgcttgccagggactggatcccctagatccagaatttccaaccaagggatctgattggttcagatcatttctgttttccaaccctgcttgaggatgcggagtgggcaggagaacgagagcactgttcgcatgagtccgccatgtgagggcaaggcagggggtgagcggcatgtgaccactttccagacaaaaccacctttccagaatgatgaggttcccaagccttcataaaagcaacctgcatgtgcgggaagagggctgcctcatccctgcccaggcttgcctctgcacaccccttcccgacaccagccctttctttactcagtgaccttgagctgctaatctgaccaaagtgcaggacgtcctttgtcctaattacaggtgggtggactcatagtcctcaggcctaggtgaccatgtggtttaccatctccgtcttaataccatgccagtatgacgggcctgtatcctggggtgcgtggtcccagcagagccacgctgagctctctgctctgcttctcctgtcccccttgggtcggccggccacgtggagcccgctttcctcctcgcacccactccactcccataacccggtggctgggtaggctaagacctggcctttctataatggcctttcttttgtttcacttcatttcactccatttccctactttccctttttttctgatagtttgtccagagggtctgcattataagttattcttttattcaacattaataaaaatttcattcatcactactgcactactaatatcagagcccaccactcactgagcattgattctgttttgggcactgtggtgtgtcttcgaatcctcaccaggatgctgtgagctgtgaactattagtagccctatttgatgaatcaggaaaaaggaggcacagggaggtcaagtaacttgccaatgtcacacagcagcaggtcgtggagcttgggtttcaatgccaagtcctgagtttgttttatatggaaagcacaagagacattggcttccacctttggtaacagatgattgcctatgtttatttcccttcccaggcggtaacactggatgtaatgttagggcatctatgggatagggagatcttagcgctggtctaaggaatacaaacatgactttagttggtgtctaaatccatagatgctcagcaccgaactcagtctgacttccagatgctaacaacacaccccaggcaggcgaaggggcatgcttttccatactcttccttttgactggcttgatcacagactgctgctccaaagctggtgttacgcacagctcctcgtcccctccctgcctgcccagggccagcatcaggggctgtcatcactgggggatgcagagctacctgtaacagcaacaaggaccattgtcaactccgttcccgtctgacacccacactgcacctttcagagctgaccataagggttaccctcacctgcccagctgccagggaagaggagggctgtgggcttcattccgaatcaccagataaactaaactaggaaacctgaggcgagccgcagcctcagtttctctttggtgttgccgcccacagttcccgctgtactggttcagcgtgccagccatcctgaagggctggatggatagggtgctgtgccagggctttgcctttgacatcccaggattctacgattccggtttgctccaggtatgtgctcttggataaggatcactatggatagttggagggaggggacagaggatgcgtcttctatcaagttatatttctagtttccttccttttcttagcaaatatcgattgagcacccactatgtacaaagcaccatgtgctgcacacgggtggacacagcatcgtttctgaaatcatggagctttttgtctggtggggctgcgaacacatccacagcatactacacgcatggcaaacaagggagtgggtcaggtgtcaggtgacgggggacctgggcaaccttatgtgggcaacccggtggccagccctggctccagagagagtatctccctggtgcagagcccagccctggcctggcacaagttcacccccttgagcatcatgtgcctgctgtgagaaaagaccatgcgacacccacgtggcaggatgaggagggcatggaatctggtagatgtgccacatgtggtagctatgaattcttactaaaacaatgatttttaaggctgggtgcagtggctcacgcctgtaatcccagcaatttgggaggccgaggagggtggatcacttgaggccaggagttcaagaccagcctggccgacatggtgaaaccccatctctactaaaaatacaaaaattagccgggcatggtggtaggcgcctgtagtcccagctacttgggaggccgaggcaggagactggtttgaacctgggaggtggaggttgcagtgagccaaaatcgcaccattgcattccagcctgggtgacaaagcgagactctgtctcaaaaaaaaaaaaaaaaaaaaggaacgatttttaaattctaaaagcttcagaaaataaatgcacgtaagggaaacatactgagtaaccaagatgtgtcttggaccatgaatggtgctaccacttactgagcagccctgtgtgctgggaaccttgtcctgtggtcagtgcctcggccgtatccatcacacatggtgtcatggaaaccaggtttccaccagcaacctgggcatgttagagcttctgtgtctgcttggtccattcacttggattgtctcctcctcctcttgggatgtcattgtcacctatggatgggagtgttgcatttgtccatccctggagggtgtccacacgcatgttccctgctggctgtgctgagcccgtgtgctggaggctcagcaacatttctgtcctcttctggagtccacacaaatgcatctgctttctcccttgcagggtaaactagcgctcctttccgtaaccacgggaggcacggccgagatgtacacgaagacaggagtcaatggagattctcgatacttcctgtggccactccaggtagaccagctgcgagtggctcccttgcttgttggcacacgcacacacagacacacacatgcacacatgcatacacacacacacgcacacacatacatgccctcagctccccgaggggtgagatgagatgggatggaagcgtgatgccccacaccattttgactcccctggatacaagaaaattataacattttgccccttttaaatgctttacttgacagatttgaaaagcttgaccaatagggaaaacatgccctaattatagcttttgatatggtttgggcagaagctaagccaaacctgcttagcttggtcagcagaatggccccaaggtggccctgcgtgtgttgtgatacgtgcgggtggaggccatccatatggctctggcagtgcttggtgagggcagcactgcccttggaccctggcaagtggcaccccaggccctgcattctgatggccgcatgctggtctctgctggccatgccaacccccacaggggcaaggggcctatggagccagcacacacccacctcccagtccgcaggcccctcccaggcctgcttccccaggggacctcttggtgcctgcgtgagtgtccctgggcctgaaatgtggccgagtagtggccacctgccaaagggaaggtggtgggcagagcagttccaacgtgctggggtgtcccacgaaggaacccctggtgaggggtggcagagggagggagtggggagcagactccaggtcaggggctccagggaacccagaaacctaggggtcaactgttcttccaggttgtttaagggaggtttgtcgagacagggggagagctcgttcttgaggggtagggagtttgctgggaaaatgcacgcgtcaccccttttctgtgaactctctctaggtgcacgtgccttgcccatgtcctattggtttggtattttttaattttctatttgtcagtgctcttcatatatcagagaaattaatcctattatgtcctttcaaaacacaatgatttttccttctacaggcagtgcacattgactaagttcattccttgcttttgttgttgtttgctattataaataggattttgtcttcaattatatcttctaaaagttcttttgattggtgaaagctattgattgctgaatattggtttttgaccccgaccatttgctgttttctcctcctaatcataattttttcttagttggtttccagtaataaagtcatgttgtctgaagctgggtgcggtggctcacgcctgtaattccagcactctgggaggctgaggcagtggatcacctgaggtcaggagtttgagaccagcctggccaacatggcgaaaccccatctctactaaaacacaaaaattagccgagtgtggtggcggacacctgtagtcccagctacttgggaggctgaggcagcagaatcgcttgaacctgagagacggaggttgcagtgagccaggattgcaccactgcactccagcctgggcaacagaatgagaatccacctcaaaaacaagcaaacaaacaaacaaataaataaaatgatgttgcctgaggaaaaaaatgtggatagtggtgtgtgggcctctcactccccacctgacagggcaggcctggatgagggtgtgggttttaaaggaagtaatgcagaggattgagtgtgacatttttagaaaaaaagtggtcctctttgaaaggaaaaagtacgtgattccagttactgatagtctactgaaggaaatgataatttataaacctgaccttgcttcttcacaggccaactggtctcttatgtgtcattagccaagttcaaattcttcttgcttttaaaaaaatctttttttttttcagtttgcagaagtacatattatggccaaaaaaaaaagagacaatatgaaatataaaaagagaaaatccctttaatccctcccacctcagaaagaatcactttaaatggtttgatttattttcttagggcctatatattttctcacatacataatttttattataggtttattacatttactgctcttttacatgaatggtatatcataaatacggcttaaaatttgtttgttattttcatttaacagatatcttgaacaaacttccatggtatatattatagctagaataacctcattctggaataatctatagtgtgaatgtaccataatttgcccaatcaagcagaactataatgtttggcatctgaatcagttgcaaagattgtaggttaattgcagttataaaaatagagcttggaaattgcaactgccccaagttcttcacggctcttatgcaaggctgtgtcctaaagccatagggaagtttagctttcagttgcctgtaacattaaggttgtttcatgattttttgaaggtttgtttcacaccatttccccccttaaatcatttaactgaatggtatgtaacaggtgtagtttctaatgagttcttttcttcccctgtggctttagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgg

SEQ ID NO: 238 - DNA, 4616 bp, Homo sapiens
gtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcactcactgagattttcttttctttctttcttttcttttctttcttttttaaagagacagagtttcactatgttgcccgggctggtctcaaaccccttgcctcaagtaatcttcccaccttgggcctcccaaagtgctgggattgcaggtgtgagccaccacacctggcccagattttctttaatatttgtctaatatctttccatctccctatattcaagcttcatgtaattttattttctggtaattctctgagcatagagctggatttgctagtttttttattttatgactcaacatgacagtttctatttttcatagaaaagttgaatctgggcctgttgcttaattttcttctttgtctttttaaatttacattaggactatgaagttttaattgaacagccattaacatatatggttatatgttgcatgatgtttcaatcagtgatggactgcatgtacgatggtggtcccctaagattataatgccatgttttgtttattaaaatttatttaagatttattttattatttttatagatgaggtctcactctgttgccccagctgggtgcagtggcatgatcatacctcactaggctcaagtgatcctcctgcctcagcatccctagtaactaggactacaggcacatgctaccacgcctggctaattattttaatttttggtagagacaggatctcattatgttgcccaagctggtcttgaactcctggtctcaagcagtccacccacctcagcttccccaagtgctgagattacaggcatgagctgcctgcacctggactaatacagtaattttactgtaccttttccatgtttagatacagagatacctattattgtgttacagttgcctacagtattcagtacagtaacatctctacaggtttatagccaagggcaataggctctaccataaagcctgggtgtgtagtaggctgtaccatctaggtttgtgtaagtgcattctatgatgtttgcgtgacaatgaaatcaactaattatgaaatcacttaatgatacatttctcagaatgtatctcttttgttaagtgaaacattacaaaatttatttttttgggcacagtggctcactcctgtaatcccagcactttgggaggccaaggcgggcatgccgatcacgaggtcatctcctacaggcagtgcacattgactaagttcattccttgcttttgctgttgtttgctattataaataggattttgtcttcaattatatcttctaaaagttcttttgattggtaaaagctattgattgctgaatattggtttttgaccccgaccgtttgctgttttctcctcctaatcataattttttcttagttggtttccagtaataaagtcatgttgtctgaggccgggtgcggtggctcacgcctgtaatcccagcactctgggaggctgaggtggcggatcgagaccaccctggctaacacagtgaagccctgtctctactaaaaatacaaatatttagccgggtctggtggcgggcgcctgtagtcccagctacccgggaggctgaggcaggagaatggcgtgaagctgggaagcagagcttgcagtgagccgagattgtgccactgcactccagcctgggtgacagagcgagactccgtcaaaaaaaaaaaaaaaaaattaatggctgggcactgtgggtcatgcctgtaatcccagcaatttgggaggctgagatgggataactgcttgaggccaggagttcaagaccagcttgggcaacataatgagacccatctctacaaaaaatttaaaaatatacattagttaggcatggtggcacgcacctgtaattccagctactcaggaggctgaagcaagagggtcacgtgagtccaggagttcaaggctgcaatgagccatgactgtgtcactgcactccagcctggatgacagagcaagactctttttaaaaatagccaggcgtgatggctctcacctggaatcccagcatttttggaggctaagatgggcagattgcttgagttcagcagtttgaggccagcctgggcaacatggcgaaaccccaaccctataaaaaaaaaaaaaaattagccaggtgtggtggcacacatctgcagtcccaggtacttgggaggctgaggtgagagaatcgctcgagctgggaggcagaggttgcagtgagctgagatcacaccactgcactccagccttgggtgacggaatgagacctgtctcaaaaaacaaataaataaataaaaataatttaaaaatcattaattgccagttacaatgaaaatttaaaacttttaaaaaatttagtctgatggcattgtaccactgtgccgtgttcacgtaaccctactaataatcaccctgacacacagccacatgcagatggaggaacttccctaaaagcaagtttgagggattaaatatcatctttgtcatcatatcctcctcttttcccttttcctcctcctccttgtcatcactactgaggacagcactgctggctgtgcccaggggcccttcttcctcaacgcccccagcaccacccaaagtccccctctgtggaatcggagcactgagtgtgttggcctcagggacactgaaggaagccgcccgcccgtcctctcagccttggagtctgttcaaccattatcattcaaaccaccttccatcaaaggtttgaatacaatgagcagctgctcctgcattcctccaggacacaggttcaccagctgggtgtctgtcaaagacaatgagcctccgagttggtccaaacttgactctccttgaaggtcttctctggccatcctcaaaatccacaggatgaaatgtgttcgatgaggacaactcactcgtgtcgcggcgtttggatgggctgcggcgtggccgcttctgccgtagagacggagccttcctgtggttcgcgcacttccttcctgaagcctcatatttcccattccgttgatacttggccacctcaacctgcaacgtgcagtttccagtgtcatcttcatccaaatgcatgaatgcaagatccacagcttccctcttccaatgatcgcacagcctgtctcctttaagatgtccttggttatctctgtaaaacttgaccttaagttcttctgtctggggatcgctcataataatgccaaatggacaggcgtgtgaatgcctccacggtaacgaccagaggcaaaccggcacatacacgtttgtatttctccttcttcagcatgaagccttcctttttctcccctctttgtgggatcagtgggtttggggtttttcttggtggcagagcagcgccgtcaccgagcagccgtcgctggcctgatatgcagcggtgaagtcttcactggtttctcttctgctcctgtgtgcttgcagaaaccgggctggctcttgattgggattgtaggctgcagaggctggggaagggcagacagcctcgggagacacgccggaaagggcggctccctcgtgctcctcagtgactcagggttttggccacatagctcccctcctccaccctcgctcagcaggctgcatccggggcggggctggcaggcaaagaggctgtgtcacagcccttcagagcctcaagctggggtccctagggtttctggacctcagatcactgtgaggcaggaggtcctccaccctccctccggcaactctgaagtatgggaaggtgcgttctcgaactgccgaggggcctgttcctgtgtgggttgagaggatgggaagttgctgaaatccaacctctctgagagccggtgctgtcaccttggcctgagtatgctgaagacattaattccggttcccaagcaaaactgttagcaattcgagggctgggctcttgcctatgtctcatctcctgttagtaccgggcaccctgatacattttctgccggtttttaagaatttttttttgagacggagtttcactcttgttgcccaggctggagtgcaatggcgcgatctcggctcacctcgacttccacctccctggttcaagcgattctcctgcctcagcctcccgagtagctggaattacaggcatgcgccaccatgcccggctaattttgtatttttagtagagacagggtttctccatgttggtcaggctgaactcacccgacctcaggtgatctgcctgccttggcttcccaaagtgctgggattacaggcatgagccaccgcgcccggccggtttttaagatcttattgctgaaaaacttaaaataaaaaataaattcagtatcagcagggcagcaggaattgccatt

SEQ ID NO: 239 - DNA, 472279 bp, Homo sapiens
aagtttacagaaatgttttatttctttttgaaaattaccttgtagaaatgtgacttttctatcaaatatatctgtaattagtcaaagtgctatagtgtatgttgaaatcaacagttctatactcaatagtatttaattccttgtgcttatagttttttcaaaattggcatagactataagttctgaaagcaaaatatggaatgcatgaattttaaatgacagaattaattaaaattctttactgttattgacacgtacaattttatagaagcttggttgaataatatttgcatatgatttacatttgatttcctcatactcatttttgcatatagtttgcaggcatttcaatgtatagtaatttcatatatttggagtaagactgatagatggaagggagtcattcaactaaattgttgaaaggggaaggccctgagagagctcaactgttcttggtccttggtggcctcactgggcagtaacaagggcaagtctattgaagggcaagttcaccttgatcagataagctgagtctcgcactctggaagagacttgaagttctgttggtcaggtactttccctgaacacagtccctgccccccaaaaaatgtccccctccccaaacaaaaagcatggagaaatggtcaaaacaaccgtggctccatatatacttctttctcaattttgaaatctataaatatttatagatgttctttatttgacaaataaaaattgtatatatttatcatgtacaactcgatagtttgaaatatgtatacattgtggaatggatcagttgaactaattaacatatgtatcacctcacacactagcattttttgtggtgagaacacttaaaatgtactttcaaacacttttgaactctctagaattttagcttgtccaatctcttgagagaaatgagtccatcaatacagaaaatcagcaatgggaggcaagaagagattctttgaactaacacaggaaaaaagcacatctcaatatttatttagataaagggtgtagattgtcactgctgggaaatatttgctgggttacccatgttaacgatctgaataaatttagagttggcctacagtggtgctcaaattggctcatctccagacatgaatgaacatagagctgctctctttgcttttggtgtttccctaattctctcatttttttttttttttaggagaaagaggagtagcttaactatgggttgaggaattttagctagatgccaaaattccatgccacatgctagagcctggcaagttactgaagatgtttatagctgctatttaggcccaaagagtcaattctggcctcagggatcacaggcttttctgggatggaattagtaagataattatggttattcctacgcagagggataggataaaacatgcctcccagaaagactggtcttgtgacacatagaggataaataagaagataataaaaattggaagaagggtaaagaaggggcagaaataacagagctggcagctaactctttgtgaagggcgaaatagaatgaagagtcatgactgacttctagatttctggtctgagtgcagtgatgtcattcattgagttggaaaaaaacacaaggagaagtaggtttttgggctgtgttaacttcatagtaactataggataacctactggatattctcactaggcagctaaatgcatggtatagagctcaggaaaaatacctgtggaaaaaaaacttaaaaagtggtgaaagaatccgaggaaatgaaagaaagcatgtgcaggtaaactgaggcagggcaaggactaagactgctaccattttataaacctcaaaagccttcacttctgaaatgtttttttccaaaaagcttacggctctttgaggatccaatgagtatactaaagtagagattgcaaaggcaaatgacttcaagaccgagaatctacaaaaaaagataaataactggttataacagggactaattaaactagggaaggcatgttctgcctaagtcattcgagtttttttttgtttttcgtttttaattctgttggtgcccaagcaaaatacatcatctacaaagaggacttactcagcatggcagccagcttgtgcctccagagtaaacgtctataaaccaacttcttgcaaatcattccctgaacacagatagcctggattgaaatctcctggagagcactgaccttaacatctacttatattttcttccaaatccaacacagtgaccacagagaaggctacctacctccttttagggacagcctgaagatctgcaatactcaccagatgcctaaagaagaggttaaaacatttctgccaattcttagtagggtgagacacacctgccccttgatgccctgcagacataacagctgtctgccagtacttctcatagaactaattcagggcatcattatttagaattcagcaatgaaagagtgtgtttcctttctctcttccaatgcaactacacaacaaccccttaacattgtagagattggaaaatcctggttttcaggattttcaggaaaatctgagagcaatctctttttggaagctctccacattcctgcgatcttttctttacatgcttggagcataaggccttctggatccagagccaaggacacagtcaggctgtttaaagtattcttcagtttgaaaagaaatgggccccgtacaaatgtgtgaatttggtgaaattgcctttaacaaccttaccaaatgtatcaataccaggtgagcctttgttctgatctccatttaaaccccctgcacagcctagagcagttgcatatgacataatctctcctctccttagtatcacagctttatgcatcatcttctccaaaaagcagctttttgataaaggacttggccacttggctttctctgatctcccaatgtagttcttttccagttgtaaatgtgacccagctactaacagagagaatcactgaaaaatagaacagtggtcatacaaaatttcctttcccaaatttggcatttttacatctttgtccttaactaaactctcagcaaagcccatgagaatatcaattttcatgtgtaaatcctcatgaagtgcaaatttgatacgctcacactactgtaggttctcaataatgattgaatttaaaccatgaaataaaatccacttgtaaaaagccaggaagttgccttgtggttggaaggtaagctctgacagatcagggagcagggtgttgaactgtcccttcaaatgctactacaggataaagaaatgcttttctgtaacagtgtggaattaaactgtagctgaccagaccttttcatgatcccttctataaaagaagctcaaagcattgtgggtggtcaatccagagaatgcttaataataacccctgctggtataagtcagtattacaccattatcaagttgttaaaatcaggcttaagttaaaaactggtaaataattaacaagtgccattatttgcctagcattgaactaggatcatgatagctgcaaaatatgtatgagacatttttcagtctgtaagcatttatatgactgttttccattttaaagttgaaaaagggattcagagtccacattctctcttcttagttgtcccagcaggacagtcctcacttccccagcttattatccagaaatactgggaacattctgcctttcaggccaaatgcccccaacttccctgatcacagttgctcctgaatagtttccgggtgtactgaatgaaggcagaatgcctcagtggccccgcaggaggctttcttctcttgggaaagccccaagctgccactttgcttactcagccgactttgccctggcaactgctgcctctcttgtctgaagtctgggcatagcagcagcagctgattttggcctgccagctggtatctgagcaactgctcttggccctccttccagttcccagtctcttgcaggtacacctgctgagcaggagcacctggagcacagatgtgcccatgggatgtgatgccagtagtaccaggagcaggcacagcagcctcttcctctcggacaatgtggcggctaactttccttctggacactccattcatcaactggtgggggcactggttcaccttgcccagcatgaccttcattctcatatctggggggaaaagaaataggggaagaaatggatttagttttcaaccagttaattacacattttgcatacttagcatttctgacaagatattgtcaaatcaaagattgaattacatcagctctttgatttccaaatatcttttatcagacactccaaatatgtaataaaaaattggtaatacttcttcctcaaaaaatacttacatgatgttgataattgaatgaggatttttcattgtaagcgctaggcttcaatgcaaaaaccagaccatggtcaggccttaccaactggccaactcacacttaccaacaggccaacttaccaacaggccaacttaccaacaggccaactcacacctgtgttaagagatatgaactataaaaaccagtcctatctaatacttaggctcttataccaagttcacaatgtaaatatctttggtattataaaaacatgaatataaatatttgcagaaataatcacataaacatctatgtatatgagtgtgtacatgtatggttgcataacagtagaaagagagatggcacattacactcaagtcacaaaattaggcccaagttccccttctcctgctatctggcttcatgactttcatcctttcagcctctctgggctttagttgcataatttaatttattctcaggtgctacttcaaaatttactaaaatatatttattttaacaatgttgttttaattgatttcctctttgacattttatttgtctcttatttttctattaaacagacctaaacatcaactcagaagagtacaatatacataaacagatgatctaggcaccatataatactgtgtaaagataaagactgcaatggaaagttaagaatgttcagtgggatacatgcatgggagtataccatgcatgcaaaggtcactattcatatgccttacagtgagaaaaaggttgaacttgtcctaaaccctggggggtagatggtaatactgtcatctacttttactacgtttactgtccctgcttttctcacatctcaccaccaaatacattaaccacgcatttgtatgtattgaagatccttaacttattaagctttttgttatttttttcctgagttcattgagagctgtcttggtttgtgttaggagatagtaatcctgtctgattcatactataagagacagtattgggatagacaataccaatttcccacttcaatttaatctggaaaatgaggtaaggatgagagaaagtaataacattatatatacatatatatatatgtatatatatatatataatgcttttgatttagagcagtaaaaaaagataatcatgttgttcctattatttccatgacacatctactaatattatgataagcccatgttattcacattttctgtctcctgttccacagtccatttgtctagcatgtatcttctacagccatcaaactatgggatgattctcttgcttagagctataagaactttcaggttaccctagttttcctaaggaacctgcagctccttccagaagtgtttcttcacagctcaaactacattgatttatgcctcaatacttgtctggagtttctcatttgacctgcacagttgcttctattattagtcacctttccttatgtaacagtctcatcttcctcttaggaatttgagttccttcaaggaagaaatgtttgtgtgccgtcaaccttgctccctcattatgcccagtcctctgccaagcactgagctgggcatcatctccataattactgctcccaccaggtggaaaagacatagtttatcaggatcagcaaataaccaaagaacaagaataataaattatcaggtagaagcaaactttaaaaagacaaaaaaggctttgaattttaatcccttggtaaaaccaatagtgcttcatacaagaggaatcaaacactgcaagtcgcctattttcaacccattgaagatactgttatcttgtttttgagagaccttcattggaaatcttttcccccttgttctttaagtccgcatctattcatgaaagactaacacaagcatagctttcctttgcagaccccaaaacatttaaaaatctcccatgaattatttacatggcagctccaatcagcaacatacctgacagactccccagccgaaatgaaagttcactgtgtaaaggtgcccagagaggctggccacctcctactatgaggttatagacagaactaagtcagcacacattatgtgtcagcgccgacatcagaaggaatcaaatcctttgatcttggacctccacaggaagcttagatctcagacaaattagataaaaaatgaatttatagcagatacgtgtcctaaggcattcagctgaatgtttgggttttagggaaggaaggatagtgagtatcaaaacatatgaattgtcatgcctcctttccacctctgccttgttgatgagttcccattaaaatgaaaagatgggattttaaactgttcctccatgcctcttagaatcccactggtggatttgatcaagttttagggaaaatgggatacaatatggggaacctatatctcttctctatggaaaggaggactcactggttctgggttctttcgggtccacccacagtcagctacagcttttccagctatccttagcctcttccaacttccaaaactttcttgagcagcaaatatgcactgtgcctttgacttttaaaatttgtgtgggtactagtcactggcttcttttgcaataagaatattaacaatgaatctcccctctctctctctacctccccctaccctgttcatattttttgagcctagttccatgtgcaacattcagtattggatgatctggattcagtacagaaagcctggacttttgagcctaaacaggatctgaagcagaaggatgaaaaacagatcaaccaacaacaagaatcaaccatcttggtttctcatttgtcaataatgggcaatagtcctgcccacatatcagggaatgtatatgccataattaaatactaatgcttctatcttctctagagaatttgttcctttatgtgaaaaatattatttcttcttaataagcaatgtatgacaattgaggaggcataaaaattagagaaaaataaaaaggaaaatgtctgtagttgcacattatatcataagtaatctgcattttattgtttttgtgatactctagaaatggatatgttttagtaaacctaatttaactcattaatccatctggaatttcctttgtaatattttataaaatgtgaatcgagactgataaatgttctaaatagtcaaatttgctaaaccttttataaactgttttcctttatatttacttttattttctcttttattatatatttcattcctgtatctattacctatatatgatatctatatctacctaattggggctatttccactaatgtgcccatatattcttgtaacagaatcacattatcttaagaatagtgacataaatattatttccctgatagggctacccatttccactatcataaaatctatttattttagaaaattggctttgtatcattagtctatattttctgatgaactttggaatccatcttatgctattcaacattgcaaagaatgattggaattgcattaatcccatttatttgagaaaaactgaggcatttgcaataatagtcaatctaattggaaacatactataattccctatgtattcaagtcttctctttatactatttaataaattatagtttatttttatataggttcaacataacactggttaagacttttttcaaggcagtatatcctttggtctctattgtacatttctttattttttttctaaatatataccattgacctatacaattttttggactgacattatatttgagtgagttattcaaaatatttataaatcatggtagttaatggttgaatcttttaagttattcttaaaaaagcatatcatctgcaaacaacttccatcattgtcctcctaatttgttgtatttttatttatctattttttttatttttttgagatggagtctcgctctgtcacccaggctggaatgcagtggcatgatcttggcccactgcgccctccacctcctggtttcaagcaattctccagtctcagcctcccgagtagctgtgactacaggcatgtgccaccacacccagctaattttttctgtatttttagtagagacggggtttcaccacattggctaggctggtatcaaactcctgacctcaggtgatctgtccacttcggcctcccaaagtgctgggattacaggtgtgagctaccatgactggccaatttgttttatatatgctgtgtttcttagcattccaaaatatatgttataaaattatggtaagaatgacttatgtgttttcctcatttgaatatgaattcctctaatattccattgttaattatgatattggatcttgattgaaaatagaattggaactctttattcttttttaattttttttaagagactagggttttattatgttgcccaggttggagtgcagtggatattttcatagctcactgcagcctcaaactcttaggctcatgcaatcctccacctcggcctcctgaatagttggaaatacaggtgcataccaccataccaggctcttcatcttattcagtgggcatgctgttattcctgattattttttgaagttgtcttgtgggacaactactatattttatccatgttttaaaatagaaaatgttcattttttattatatgacatggacacattatttatcaataatttccaaacatagttttgctttcctgagaacttgagacaatttctagttctcagctcctttgcttccagatgaagctatctctgtcctttcctatccctgtcattctcatgaagctaaagcagccagcagaaaactgttaggaccccaaaaaaatgtgcattcatcatccttttgtatagttggtgaacttggataaaatttctattaatacatttcttttagaagaaggcaggggcgggtcttttttttccccagcagttgtaataactactggaatccaaaagacccttggatgtgaacacatatatagcacacatagtgtgcctgaaattgttctgtgctctttactgacaccaattcacttattctgtataataaccataactatggccagtatcactagggccatgttactgatgaggacactgaaacacacggagaaattagttctcttacttgaggccacaaagtctgtcaacagggagtcagatttaaacccagtctgttggacttctgggttctatgctcttaactgtcacactctcctgattctccaactgacaatgagaattcattaaatcttatgagtagaagagtgacatgagcagacatggatttaaagagggcttagatggctcttgatatcaaaaaacctggcaacagtaaaataggagggatgtatactttactatcttcttcccccatcacaactttctagcaccctgaccgtaccatgccatttttggtaaaagctgtaatgtggtaaatttataatctgaatctagtagtcatgctcagttccaacagctcaataatcctaagtgctatggcagtgcttagtgaaggcaaagtgctggagagagagagacagccagtcactttatcagcaaatgttaaaagtttaaaaacacagagggaaaagggaaactaaagtgccatggcaataatagaatgaaacaaaatttatgtaaagctaccaataagtaggtgtttcatagctggtaataatttccaaagaaaagcaggagatgcttcattatttgtcttcaaaacgatactcttcagatttgtacaaagcttagaagataaggaaacaaatctgctgtgatccccagaggaggattcggataacacatttttctatttttaacttgtatgtcctaataaaatggcctctttgatgctcccctctcttcaatctaaacttttccacagagccctttccctgtctcattcctaataatttattaataagccaccacataaaaaagttccttaataaaacagttaggcactgtggacggcataatgtagttaatttaagcgggccactgaaatgcacataaatggccatatgagattaagagagagattagtactgctcctgccactctctgcagatggcagctgaatacgaagagctattcagatggcagcgttcaaacacctgtcctgagtttacatgcaataatatggtcaagaggcttctaaaaaccaaaattagaataatcttagatggaatcttgaataattcccatccccttctctctttctctatttatttcaatagcactcccaaccacacccccataccctctaccaccttctggtgcaggtccaggaactggagtatggctaactaatacgatgggaaaattgaaaaaaacaaacaaacctttatttctttcatggaaaaatatacaaacaagcaaacaaactgatacacactcatgctcatgtgtgcatgcacacacacacacacccacataaacacacacatgaaagatctcactcagctacttagaggcagaataacattggactgctattttttgcttaaacacgcattcagaaccactaagattggtaagccttttcaagcagaaaatatgataattgactctttggagtatatgttttaaaacgtttcaggcccatggaaattatatgaatatttttcatgtatcatacccatacttggcaaagccatcttgtgctctgcccagtcttcctatttgcagcattcttagtaggacaagggcaaagcattcatcccaggcaaatgcttatcttttctctgtttggcactaattctaatggcaatttaacaatataacaagtaatatcatctgacataacacaccatagaggcaaatactacattttgctaaaagtacaactaaacaacaaagcacagcttaacaaagctgactcatttgtcgagggttctgtactcaatctaatttgcatagttggtatttggcaactgtactcttctttcccaaattcaataatgttgccaaattggcagctttgcaatagctaaaggaaagattatatgcctatactctggtttcccctttcctctatgtaacaaactcaaatgttaaaccaataatcttctactaaaaacaatataaatatcaattcaaataattggtgaatagctgagtgaaccagccagacctgtgtatttttctgctggggtataatttctttgaaggaaagtaacaaagactaagaaggggctataaaccaaattgcttcagagacagagctgaaggagagggaggctcagaccatccacagtgggtctctcctgtggggatcatctccaccctccaagcttaccttctcccaccacagtgtcttcttttttgggcccttgtgattctcggcgtttggatgagatgtggatatgaatattttgattattagtctgggattcaggaatctcttcaggttttgtttctgtattaatggagaagaaaaaggatttttttgttcagttgtaagtgggaccatcagcatttaggtgtttcccttgtatgtacccttgtcccaaaattatcatacacatgcaacagaaagcatataacatattcagagttcaagaaataatggcataaaatcctatatactgaccaccaactttatggtataaaactgtactgtctgatacaaatagcagacacatgtggctactgatcacttaaaatgttactagttaaattgagatgtattgtaagtataatgtacacactcaattttgaaaaaaagtgtaaactaactaatgtttttatattcattacatgctggaataatattcttgatatattatgttaaatggctactagagaattacatatgtgccttgcatatgtggctcatgttatacttccgtaggacagaactgattagctagtgacagaatattactaatactttttttaacctttaattttgaaatgagtattgattcacaggcagttgtcaagaaatatacagggaggattcaagcatcttcacccagccttctccattgtcaacaacctgtgtaactacagtatgatatcaataccaaagaattgagaccggtacaagccaccatacgcaagatgaggagggcttttaatagaagattgtatatcttcagtctattcctggctgaagagatacttcatcttctattcatttatttaataaattcattcatctaaaatatatttacattcctcatgtcaggcactgtttaaggctctgggaataatacagtgagtaaaaaagatctgatccctaccctcactgagcttttattctagtttggatggcagaggacaaacaaataaatttgtaatatggcaaagtaatgccataacatggcatgaaaaggagatagttatgggtaggaaatagaccttttctttttctttttcaacttttattttaggttcagggggtacatgtacaggtttgttacaggtaaattgcatgtcactggggtttggtgtacaaatgatttcatcacccaagtagtgaacatagtaccaaataggcagtttttcaacccttacccccctcccaccttccccactcaagtagaccctagtctccattgttcctctctttgtgtccatgtgaacccagtgtttagctcccacttataagtgacaacatgcagtatttggttttctgttcctgcattaattcacttagtttagtgtcctccagccacatcaatgttgctgcaaaggatgcgatttcattctttttatggctgcattctattccatggtatatatgtatcacatttcctttatccagtacactgttgatgagcatctaggttgattccatgtctttgctattgtgaatagtgctgcaataaacattcaaatacatgtgtccttttggtagactgatttatattcttttgggtatatacccagtaatgggattactgagttgaaaacttctgttttaagttctttgagaaatctccaaactgttttgcatagtggctgaactaatttacattcccaccaacagtgtatcagcattcccttttctccacaacctcgccaacatctgttactgttttaactttttaataattgccattctgactggtgtgagatggtatcttattgtatactagacttcaaactatactacaaaggtacagtaaccaaaacagaatggcactggcaaaataatagagacatagaccaatggaacaggtgagagaactcaataatgaagctgcacacatacaaccatctcatcttcaacaaagccaacaataacaagcaattgtgaaaggactccttttcaataaatggtgctgggatagctggctagccatatgtagaagaatgaaacttgaccttttcctttcactatatgcaaaattccacttaagatagattaaagatttaaatgtaagacccaaaactgtaaaaaccgtagaaaaaaacctaagaaataccaatctggacataggccttggcaaagttttcatgtgaagtctccaaaagcaaatgcaacaaaaacataaataaaaaaagtgggaccgaattaaactaaagagcttcttcacagcaaaagaaactgtcaacagagtaaacaaacaacctacagaatgagagaaaacattcacaaactatgcatctgacaaaggcctaataccagaatctataagaacttaaatcaaaaatcaaaaaagcaaacaatcccatttaaaaaaaatgggcaaaggacgtgaacagacacttctcaaaagaagacatacatgtggccaaaagtatgtgaaaaaaatgctcatcatcactaatcattagagaaatgctagtaaaaaccacaaggtatacattttttggataggcatgatcaagaaggatataccctgaaataaaatcacagtaaaacaaaacaaaacaaaaaaccaagaagaagagaaaaaacaaaagccaattttacttaagaatatctttgataaagcactaaagaaaattaaattttatttaaaattcatatgtgattttcccaagaaaaagcaattttgcaattgaattttgagctgaactagctattttttcatggaacaccatttttacttgaaagagcttgaaataatgattgagaaattatggttattcatacttgtatatttggcagattttattttttctcaaatgaatgaagtgagcttctaaaacagaaacaacttacagtgtttgttcccagtgataaaattcaagctttcatgggaaacttggaatttgggaaaacttgtatcaactacatgagcttcacaggtttctaattcttaatgattcatgttattaacaaatgtgatctttttgaatagtagaatgaaatatgtcaacgttgagaagatcttcacgactccgtgaaacaatattttcaaaatgaccaaagcataatgcatggataaaagctccattcaaagtatatgatgagactggtggattttcatgtaacaaagtacaaaaaggccattgagatggcactttaagtaactacttcttgtcaagtctgggtgcagtaagaaagaagaatgtccactattatctgtaaaggctattaaaatgctcatcccttttctacaatgtatctgactgaggctggttttcttcatatacttcagcaaaaacaatacattgcaataggtcgaatgcagaagctgccaagagattccagctgcctattaaggaagatattaaagaggtttgtaagaatgccacactcttttcactacatattttttgaaaatacaactttttaatttaaaatgttatgtttacatgcaatgcatgtattattttaaaataagttaatgaataaatttaaaattttctgtttaaacttctaatttggaaatattaatggatatagaacccacatagacaaaagttgtttagattctcaacaattattgaaagcataacaaggtccttagacccaaattgaaaatgacaggcacagagagcatatagcttaaccagagaatctttttttatgagtaagttgtggaacaatatatttttctgattctgaagaaatgaaagttaattttagaaacttaataaatataaaatacagaaggtataaggaagaaaatacaaatcacttatacagatctgactactgtaaaactttcataaagttccttgcaatttctttacatcttttttgtttgtttaacatagttaggagtctgtgcccagtaaagaaaatatggggatatcatacaaggtaatgtgtccacagatattgaaaggttgaaagaggaaaaggaagacactgaagtaatagatatatttgtaaacacaggaagaagtcacgtctagagctgggggatcaaaagtggagatagcagagcttaggagttagaaaaagccttctctagagcttaggattaaaagtgaggttagaccttagggagagacccctgcatggctactaggtttagataccaaatggaagatgagaatcaaatcacctacttcacgggattacatgagataaaaatttatgaaaattctacttacaagcagacagcactacatacactgaatgtagatagaactttaagaaggaaaaacaaaaaactgcaaatcacagcaacataaggcagaacgaggtcaagatccccttcttcttcagaaagacaaggagctgccttgtagttagtccagtcctgatcaacaggatgaagagagaaacagggataccaggctgtagctcagttcaaatacagaaaatgtatccagtggagcctcctttcccaagcatctctcagagctccaagcccagcaaatgttgtagtagtgggactatgctacttcctctcacctttattttgacttttttctctttgcctctctttatttctcctcttttaaacttcactcttgcttttactttggttttgtagagcctcctagtaagacaagtatttctttcactcattggctggtctagggttgggggaatgggtggaataaggaatttgccaatgcctgatctgctcacctatctcctccactctaagatagaaagaagcttcatttacaaagcttctttccctcagtgactacaagtctccagctttaaaaaattaaaaaatggcatccacttctgggaaatatttaggaacctacttaattcctatgctaaaaaacaaacaaacaaacaaacaaactaagccctctccccttttaaaggagaagaggagaggatgacatttccccggattctttttttttttctttttttttttttttattgtgacagaatttcactcctgtcacccaggctggagtgcaatggcgcaatctcggctcactgcaacctccaccaccatctaggttcaagcaattctcctgcctcagcctcccgagtagctgggattacaggcatctgccaccatgcccagataatttttgtatttttagtagagacagggtttcaccatgttggccaggctggtctcgaaatcctaacctcaggtgatccacccacctctgcctcccaaagtgctggtttcccctgattctttaactcactttttgaagtgagttacaatatttttcacccacctcattgggttgttgtgtggattaaataaattcctttatctgaagtgctcagaatgtgttccatagtgagtatttagttaacatgagtttttattattattgctattattacttaagattaggcaatccttgtctctaatgtattaattgaacaatttggctttgtgtaattttatattttagagaagctcacaaaaatttgtctttggggaaagaaacagaatcattaatatgttatgtatgatgacttttttttcagaaattttcattccaaaataaaaaaaaaactacatacttctgcttttgcttcttttaagccaacagcacaccagacagctcagagccagccatgaggccacagaggacagggaagcagccaggatgatggtcgacttctccttcctagtcacaggcaagacagcaaatggcttggatcgagctgtaaaattgactcctgtggcggggaaaagaagatgtttcaatgatatgttaataagatgctaatataattaaaatatggtaaaaataaatacattcataatagtatctgggatatagtaggtgttcaatatatattcattaaatttaataaatacataaattataaatccaagatttatatttctagagaatcacaagattccaacaataacacataatagttatttccaattctgtcaattattgattgagaattcttccaattctctcttttaattttcagaccaaccttccataccaatgcaaaatttcagcttctttcactcatgtttcactaatgagaataaaaatattctcagctccagaatgtgtgaaattacttgctctgatgtatgtatctactcaatacgtgccatataacacatcaaaacaggggcatagggactcctgctgcagcaccatattgtcttagagagttatgttatctggaaaactaggactagaacaatggcagatagaactgccggccatgaatgatggggcaagatagcatcctgttgagagagttcaactctgtaagaattcatctgaaactcctcccatttatggagacagaaaaatttctcaccccattattatttatgaaatgagtcataaaataatctaaaaaagaaagttacctatctgcataaaaacacatacataaatgtttttagcagctctgtacattgcaaaacccaggaacaacccaaatgtccttgagcaggggaatggataaacaaactacagtttatctagacaatgaaaaactactcagccaaaaaagaaagaaaggaaagaaaaaggaaaagaaacaaacacacaattgataacctgtaacaactagaatgagcataaaaggcattatgctgagtaagggaagcccatctctgaatggtacacatttgtaggattccatttatataacactgtagaaaagacaaaactatagagttaaagaacagatcagtggttgccaacgatgaatggtggagaaaggctacatgtatgtgagaacagatttttggggtgatgaaatggtccttatcctgactgtggggatggttacatggatctatacatgtatttgaagtaataaaaccacatacaaaaatgtcaattttaaagtacattcattttaaaaataaattgtttgaaaacttgcctttaattttgggggtgatgaatatattcattattctaataatgaggatgctttcatgggagtaggcattcatcaaaatgtatcaaatggtatgctttaaatatgcttatcatgtgtcaatcatatctcaatacaaacaggtttatttaaaaaaaaaaaacttgtttatgaacagttacagccagcatttttaaagcagctcattcaaaacaaacaagcaaacttcaaacttctgctttcatccacataactcaggcaaaaagagtttttattttatgtactcaaggaaacaccatgtttttctttgctgtgctttcactgggctgaacctgacaattttactggaagtcacagtcagatcttcaatctcttgacttctggctgacttggtcccaaagctactacaacaaaatctcctctgtatacatcatgtatctgagccatatttggcttgtttgttatcaagtaattgctttttatgggcatctgaataagctcaatcaggcacagagatgggggaatagactttacttgggatttacagaagtaaaaactaaattcttcatacttttatccatttgtcaatgattgctcagtaattgtttactgggtcaagttgataagttaccagttcccattcttaagatatttacaagctagtaaataagatacacataacaaacatttgttaaacaaattaggatgtgacacatgccactagaataatgcaaatcaattgctttggatgtttattttccattgatatgattcgggaaagcatcctggaggaggaagtatctgaggggactctgaaggctgtgcaaatacataaacaaagacagagaggagaaaatagctattgatacttaggagacttacgcaggaaagtactggaacttaatgctagaagaatttgagacaaatctggatgggcattaaatatcaggcaaaaggcccttgagaacattctgaaggcatgaagtatcacagaagaaaagattcttttttatttttattttgttaatagagacagggtctagctctatcacccaaacttcagtacaatgagtggcacaattatagctcactgtagccctgaacaccagggctcatatgatcctcctgcttcagcctgccaggtggttgggactacaaccatgtgccaccatacctggctaattttttgttaatgtattgtagagatggggtattgctatgttttccaggctagtcttgaactcctggtctcaagtgatccttcagtctcagcctcccagagtgccagaattacaggcatgagccaccccgcacagcctagggggagattctaaactgagaagtgacatgagccacataaaatatagtcagtccatttttgtatagaacacaaaaatgacagagaagctaaagtcagggtgaccaggcgaaattatctaaatccaagggtggagaccactggctctcaattatcttagcatcagaacattttttaaaactgcaatcttaaaaataatctcaatatattcacttattcataaacaaatatttatttgtagctatgatgcaccaggcttttctacacccttgggatataatgtcaaactaagcagaatctctgtccctttggaactttggtctcaatggaggacccagcacacggacagtagacaaacaaataaatacatagatactataaagccagggagtgataagtgcataaagaaaactaaagtgagtttataagacacagtggctggaggtgtggggaggattggggatggtatagactgagtgatccaaaagagtcctctttgaggagatatttgagaagaaatctgaatgagctgagttagccacgtgactttctggggggagaatattccaaccaaggaattggcaaccacaggtagagtttctctggctaactgtatttgtggtgaaggtgggggggggcggggggccgggggcggatttgtgggtgatacctggttacattaatctcttctcagcagcagcccctgagggcctcctgagaaccccacggcaccaagaaatggtcataaaagccacagcctacaccatggtaatgatagtgaacgtggaaaggctagctacgaagtcagtactacaaacttacagaaacccttatctcttgacagtgtctcaggaagttgagaagtgataaatgagctggatttgataatatgtcagacctaagaggattccataaatacttgggcagatctattttctgtatttctaaaataggaataataatttgtttttctctctaaaatattggagagatgagggaaaatagtggaaatgattgcaaattctctgcttgattcatgaatgaatgaaacaacagaccaggcacggggactaatgcctataatgccagcatgagcccaggggtttaagaccagcctgggcagcatagtaagatcccatctctaccaaaaaataaaataaaataaaccaactgggtgtggtggcacacacgtctgtagtcccagctactttggaggctgaggtaggaggattgcttgagcctgggaggttgagactgcaatgagccatgattgagccactgcactccagcctgggtgttgggtgacagattgagaccctctctaaaaataacaacaacaacaacaaacacacacacacacacaaaacaacaaaagaaacaacaataacataaaacaatgcttatcagacctattattttgaagcctattagaaataagaaatttcattgtttggcgaaaatgtgtgaatatacgctgctttccccaacattctagcacttcaaattgatgtacttggaaacaaggagttactctctggacgtgtaccgttactcagtgtgatgtcaacaaggggtcacagaagtgcagatatttaatatttttcctttctttttatcctccatctattctctccaaatttaaacttttataaatctcattctgaaagagtctcacctaacagacttgatcttgaaaattaagaggaataatttagtgaaaaacactaagggaaaactttccaaatgattcttcagttagttctttttacaggctgtaagtagaaactacaataaagcagtagtctactaagtgtgaacaccaagaccagttcaaaatcacaggagttaccaagaagtttctgtctacaatacatttcgcatttggttttacaacctattccttaaaataaacttgataacgtatttggttagtcttaattaattactgaggtaattaaaggacaaaggccttttaaatgtcagacaaatctggaacaaaatatgcattcctgcctgtcttaccctttaagacatatccattcaaaaactcaagcttacagcacaatccctgggaattgggaatcccacggtcaaggacactacacgtttgttatgaacctgtacttatgttaggacactttgacacataaagtatgtgtaaattgctcttttaacaagtatttaagcaatcatcctctgaagtataaatgtgactctcatgaaaacatataatgagcacttgtcgacaggttatttatctcattaatgaagaaaccaggaagaacatgaaactggtttaaatagcatttaagagataatgatcatatagccagggagcaataatattatctgatctcagaagatagtctttttgttaaaaaaaaaaaaaatccaggctgggcgtggtgactgatgcctgtaatcccagcacttagggaggctgaggcaggcgaatcacgaggtcagaaattcgagaccagcctggccaacatggtgaaacctcatttctactaaaaatacaaaaattagccaggcttggtggcgcatgcctgtaatcccagtgactcaggaggctgaggcagaagaattgcttgaacctgggaggtggaggttgcagtgagccgagattgtgccactgcactccagcctgggtgacagagtgagattccatctcaaaaaaacaaaaaaaaatccaaaacttggaattaaaggaaaaatgattatgattacagatcttaccagtgtcatactggaacattttcaaaaggcccgttgaaagtttattaagttctctcaaacatatatttgtttcacttactatttattatttatttattaggacccagatatgtttatttgtagaagattgacatgctgaaacaatttttatatagttaaggatgcaaatgatatctgtaaacactggactatcaaaattttgcttttattgccctgtatccattgcaaacttatttcaacatttcttccctggctatacgatcactatctcccaaatgctcttttaattagttttcttatcttctgatttcctcattagtgagttaaataacatgttgacaaatgatcactatattttcatgagagtcacatttaatacgccagagggtgttttttttacatgttttgtcaaaaagaactggatcagatatgcaatttacataccccttattctgaagtgccaggatgttgatgggtattgtccccatttggcagggggttgaggaggacaggacccaaagttaaaatttcaacatcctatgactctctttcttataaattaacattctcctattaatatctaaccaaatgtcaggtaagtaaattaaagaaaaaaacaagtagaacactgaacgtaaacgtcaatgttgagaaggaaatgtacatttggtttcttgctcaccaggagtaacctgaggtttccatttctacatgtgctctttcttctcaagcttaatgatacagtcaagtgaatttattttctaaactatgatgacctcttattcatgatagtagctattcccactataagggagaaaggattatcttctcaaaaaaaaaaaaaaaaaacacagaataaaagcacactgtataaaattacctggaggagaagtgacagtaaaaataaagtgccagtttgacccagagatcaagactgccaagttgtagaagctaacataaccatcttgagtttctgcctgggtgcaccctacaaaaaagtacaaaacaaaaattagctgtttattatctaatctcgaacaatgtcttcatgtcttctgcgaaggcagacatttggacaataaaggacaattttttaaactcaaagaggttacctaatccatcaggttcttcttagtcaagacttagaaccaaatgacccaagacagaataacagttaacatatattgaaagttccactatgccagacactgttctatatatacacgattgcctacaaactacacaacaaccctataaaatacgctattatctatattctagcaattaggaaataggctcatgaaagattaaattatgtggtactggggttacagcccaaatctacctgatttcagtctgcattcttaaccactacaatatattggctatattattattaaatgtataatatataaagaaagaaattctattatctttctaggtggtcagtttctacagtctgtctttcttctatccaagttatctatagtttatgtggtaccagaattaggccaagagatcaggaccatggcaatctaccaaataatgactgatagagctactctgatttagcaacttgaattgcctgagccttggcttccctaactaaaatgaaaaaaacaaaaacaaaaacaaaaaaaaacccttgcgtcttctaacagtaggtcatccatttataacgtgaaaaaaggcagcttaactcagtatcacattcacaataccattaatcgtcttttgactccaccatccctaaattattttcctaattaacagctgctagactttactctggaaatgtcaatatgattggcatggtggacaaagggttatgaaagtggtctgaaagtttatagattggtttgagatctctaaggctgaaatgtgtcataaagatacaatatgcttagtgttacatttttcaattcaattgcttaatctttttgtgaaaacactgtctttcttcatcaattttgcagagctaactaaaacttcttttttgagaaagatcttttgcttcatctcttctgagttctaaaataaataaaatgcccagtaaaatgaaaataaataagccaagactcaaataaatgataggtgcccaagataaatgcagtttatactctttaaaacctatatgcatcaaaattatggtcaataaactcttgcaaacaatgaactgaagagtacagatgttcaacatgaaatcatttgctgcagtttttcctttgacaaacgtctttattgttcccatctttggaagaatacaaagcagcatttaatcgaaatgtgtccgtagagcacagtgagttggcctcgtagaacagccgccaaattgcctaatggaaagtgctttagttctaaatgggtttgcttttgcgttaaataccagcttgccttagagatctctacaaagattcccatatatatctatgatattctcagatttgaagcatatgtgctcaaaagctgaggcagttgctgctaagtatagtacattactccagggttcatcatatcttcagaatagctatgatgacatatacaaatgcaattgacaggctccctgatcatgctggtataaacagtatactggctgggggacttgggatggggtggggtgctgggctcgagcaactttggaattgattacacaactaccagggaatgatacctgaatgggtttctgcaggatagatagtttctaaaatacctttgcagcccaaattatccccacagctatcccactcactcctaggtatgcatactagcaaactgttacattgttaatgttgagatgttatctttaaaagtattaaggacttttttgtgcaactatgatccataaatgtcaaaggatattgaagacctgtaaataattgtccttgagtatataaattcactttttatgataataggttgtaactgccttttcactgaggagggtctactaaagaaaaaagaatatgaagttaaattgcagaacaaaagatttagaggagatatatagatatggttttgttgttgttattttgtttttctccaggagatacttatagtaagttagataatccatcccaaatgcttttggtgcattctttctgaagtgaaaaagtagtatttcatgatggcttcaagagaaactttcaatcacataaaatagggtagtttggtgacatgggtatgctaaaaacagaaaactgcatgtgatttcttccctacttcatgactcactcacataaaaaaggtgtgtatataagacaccctcaaactagtcctcacacattcccattggatctcttaaaaaaggtaatagtgacaatactgatccaagtgagctagttggcttgagtgtggcttggtgtccgtagaataaaagagtaaatggtatctcatctcacaccagttagaatggcaatcattaaaaagtcaggaaacaacatatgtggagaaatagtaatccttttacactgttggtgggagtgtaaattagttcaaccattgtggaagacagtgtggtgattcctcaaggatctagaaccagaaataccatttgacccagcaatcccattactgggtatatatccaaagcattataaatcatgctactataaagacacatgcacatgtatgtttattgcagcacactcacaatagcaaagacttggaatcaacacaaatgcccatcaatgatagactggataaagaaaatgtggcacatatacactacggaatactatgcagccataaaaaagaattagttaatgtcctttgcagggacatggatgaagctggaaaccatcattctcagcaaactaacacaggaacagaaaaccaaacatagcatgttctcacataggagaagtgggagttgaacaatgagaacatatgggcacagggaggggaacatcacacactagggcctgtcagggagtggggagcaaggggagggatagcattaggagaaataactaatgtagatgacgggttgatgggtgcagcaaaccaccatggcacatgtatacctatgtaacaaacctgcatgttctgcacatgtatcccagaacttaaagtataataataaataaataaatagataaataaataaagagtaaatggtttcatgcctcattcacttttcatggccacaacatgattctaagctggccgggcatgacatccttaaggttactgaaagaaaaataatgaaagatgaggtgcaataagtgtcaggacaaagtaaaatataaagtctcagtaaggtatcatataggagaaggtatggggaataggtaaggcatggagcataagtaaggtactgggtataaataatgtgcaaagtgtggcaaggtacagaatataagtaagtaagatatggactatgggttagaaatgaagtgtgagtaagggtctggagaatgtgtaaagtatggaatatgagtaaggtacagactatgggtaaagtatggagtgtgaataaggcatggagtatgtgtaagttgtggaatatggctaaggcatagaatatgagtaaggtattggacatggtaatgtatgaagtatggcaaggtaagggatataagtaagggatgggctgggcacggtggctcacacctgtaatcccgacactttgggaggccaatacgggaggatcacctgaggtcaggatttcgagaccagcttggccaacacggcaaaaccccgtctttactaaaaatagaaaaattagccaggtgtggtggtgggcacctgtaatcccagctactcaggaggctaagacaggagaatcacttgaacccgggaggcagaggttgcagtgagacaagatcgtgccactgcattccagcctgggtaacagagccaggctctgcctcaaaaaaaagtaaggtatggactatacatagggtatggagtataagtagggtcttaggtatggataaggtctggaggagcaatgtaaggcatgagtatgggtatggtttggagtatgggtaaggaatagaatatgggtaacacatggagtagacaatggggaggtgagttccagtagtcatgtgagagtatctgtggtaaatattaccagaacatgaaaaaagctaaaaattaatatttctatgctgctgtattaagatcagaaggtgagtgactgttacatatcctaagcactttctataccaaaacaccaacagtagcaaaatggcactgaaaaatgaacagaatgacagcatcaaaacaggcagttcgaaatgcaattctgaatctttcatcttcacagtgggcaaccttggataaattcacttcattttcttactttcttaatgacatgccttgtgtctacaaatctgtacaaggaccattctggtttgtcctcattccttgggattttaaacccaagaagcttctaactgaactgcccacattaaaaaaataaaaaaaaaaatgaccaggagcaacaatatgagttacccacacaggtgttactttcaacaaattgaacaaaagatagattgtgtaagtagaagggaaagtctggagagtctatgggcagattctgacaaaatatgccacattacctgggcctttaaatttggattgtataaagagaacgtggagagggtactgaggagagcaagacctcaaagtttggtagaaaattatttttgtggacatgctgaaaacatttagagtctcgttttgttttgttttttgtttgttttaattattttattttattttaaattccgggatacatgtacagaacatgcaggtttgttacgtaggcaaacatgcgccgtggtggttggctgcacctatcaactcatcacctaggtattaagccccacatgcattagctattcatcctgatgctctccttcccccttagtcctccccccaatctctgacaggccccagtgtgtgttgttccctgtgtccatgtgttctcactggaaaacatttggtgtcttaataagtaattagatgggttaaaaaaaataacaggtcaaaatagtagaaagtcaaattgaaaagagagtgggaaaatttattgttctaataaaacaataagacgaagcaagctttaaaaagtaagggttttgaagctatgaactgtttaatcacgagatgtcaatcgcctccttaagagaatttttagaaggggataatttcattttctggaatcgatgaggtgcagctttgccagaaacaaaatgtataagctaaattaaatggtgacattaaaaaaaaactgagatctgagattaattcattgaaaacaacatcaaatgattattcattaacttggagactttattacaacaattttatatgtttcttaagagacaaataacaaaaaattaaggaacaatgtcatcagaaatggtaggcaatgtgcaccatatgataggaacagttttaggccaataataaacgcaattagaagacgaggcacgtctatgattgacttatggctatccatttgaacattccatatattttatgggaaccatctgaatgagcttagactcatagccagagtagagcaagaaataactgtaaaatcatggcctattcttggaagtcagtgattttgcaggtaggctgatgtttgagctggcacatgagtcatttctaagcctgaaaaaaacattttggacaacacaaaacccacagaaatgccctacctgattcatgaggtgcacaggaaattggataagctgattttgttttgttttgagctggagtctcactctgtcaccaggctggaatgcagtgggcgatcttggctcactgcaacctccacctcccgggttcaagcaattctcctgcctcagcctcctgagtagctgggacttcaggtgcatgccatcatgtctacctaattttcgtattattagtagagacggggttttaccatgttggccaggatggtcttgatctcttgaccttgtgatctgcccgccttggcctcccaaagtgctggcattacaggcatgtgtcactgagcccggccaataaaccgaatttttaaagagtggtaaacacatcctcaaatttgcataagaatggagatatttggccaattataaaaaggtacatatacaccatatcaatttataattttcagtgatttattggtatgaaacttcctttcaatatgttactggctaatctcaaagaatgtttcattataattacaatactaactgcattaaaagccagtgcttgaaatcacacttctagaaagaagaatttgcaaaagttaacaagatttcctacttattcccctattataatatacaaatatcaaggtaataatagataattgtgcttaaaacaaataacctttattttcttttttaaaaaatttttaccagtactgatatatatctctttgtatagtatgcatattttgaaaacattattttcttttttctttttttcttgagacggagtcttgctctgtcacccaggctagagtgcagtggcgccatcttggctcaccgcaacctctgcctcctgggttcaagtgattctcgtgcctccgcttcccaagtagctgggattacaggcgcatgcccaccatgcccggctaatttttgcatttttagtagagacggcgtttcaccatgttggccaggctggtctcaaatgcctgacctcaagtgatccagccaccttagcctcccaaagtgctggattacaggcacgaaccgccgttcccagcctgaaaacattattttcaagtcacatttgaaatcacaaagaatttataaattatttctcatctaaaatagcaacacaatatttagtgcagagatttgcttgagtcctagctcttggtcagaattattcaacaattctgaattcaaggagtcaagataaacccattggctctattcttttactgggaccctgcaaggatttttgaaaactgtctgacatagaagttgtggggaagggagtgaatgctttcctttctgaggatattttccatctaccttaaaaatcatttttaatccatttgaattcttgggacactttttaaattttctcattgaaactagtgggagagattaaagaaatttaacagattcactttttcagactgttgtaatctccagctccctatccaaatataggagatgatttttaaatgttccatcgaacccttctattctaggttatatcaggttgacataaaatgaatttctcttcacctcaaggtgaagcccagaattggactgtgatattgtgcatgattgggactccctccgatgagaaggaaatacacaatcctacccataagcagaggaagaatttcaaggtgctgtgataattgtgaggccccttgtgcagagaggaaacccctatgcatgaagagtttgaggctgtcaggcaagatctgtgtgttgggagattgactgcacacaatagggagaaggctcctggtaggaagcatgattaataatttatgggttatgttggagggaggcaggtaagaagaaaaaaactcttgtgacacccagaacacaaactatattaattgtaaaacacaacctcttgctcttactgccttaaaactgaaatcaaaagggcctacgtcttaatttggcccagcaaccaggttgtacttaccttttcatgtttctcatcataaaaactcttgctttttgctcccaatccagtcttccccatttcagtaaataacaccaatatccacccaatataacaagatcaaaacctataagttgtccttaagtccttgttttctttactcctagtagattctgctgattcaacttctaaaagacattctgaatcaatccagttgtgatctccaccatcccttgcctggccttttgcaatcactttccaactggctcaggaggttcactcttgccattctccaatccaccctccatagagcagagtggtcctctaaacatgcgagtcagaccttggaactggcctgcttaaaaccctccaatggctctgcatctcactgagagcgcagcccaaactccccaccatggtccccagagtcctctgttgactgtctggctccagcacctgtctcacttttcctcttcccttgatctcccttagttatgaggctcctttgccttaattctgtttctcaaacacattctccttaacatattttctgtggataatatattgtactgtttgacaacataaaaatacaatgattgaacaatttcgtaataaattaatatgtgtctcttttgtctctttgagtaggttgtatttcaacggttttgtgtgtgagagggttaaataggaacttagaactcagaaactatttttcccataaaaatcatgttacacctgcttgcttctctctagaccaggccctaaaatgcacattattgggtccttctgcagaatatgttgccaaactatcttgggcctagtagaaatctgcattttaaatagattttcatataaatgagcttcaaggaaagtaagtggagctggcagtggtgctgggatagaacaggaagacaaaagagggtagacaaacataaggagaaaaactagctaagggctgctatgggtcaggtgcttttgcacttatcatcacatttattcttcataccactgagagcaagtctttctatttccccatagaaatcatattgtacttggtaaattgctccctggcccagtccatgatactataccaaacaagggtgtgtcgtgggggcactgagtggactgtagaaaacctaggatttgatgctcacccaaagatgccaggcacttttccttacactaccttaaggatacggataagttggaaaggttgctttattgtgaaagggaagggagagaaaaagtggtgactttaggatttgctgccagcctaatcttccttttcacagacactgacactgtagattagggatgaaggagtttcttcccaaattactgaagaaattcagtattaccaattttgctatgaattcctaatggctgcaaacattttctgtgcagataaagtggtaacagatatctgaaatttacagatactttacctaccttttagcactgagtctgatgctccttccagggaagctgaaattgtccatggctctgaaggaggtcccagggactctactcttcgattctagaaatgggaataggaggagggaggaagaaaaagttggattcagaagagaattttgtgaagttagaaaagatggatcagatatttgcttttataaagcatatattcagtagaaataaaggaaagaaagtgataaataaatgtctttctcatgttaagaatatatcagaattaacttattgtaagaagagtgaggaaattattgcaagacaagttggggcaggacagtgaggagaggaaaggaaaactatgtttatagaaaagaatggtactatgtgctgaaggttcttaagaaaggaaaggtaaagagaagaaaacaggagagagctgggtgagtgccagaccacatcaaagttgacaggttttcaagtgtggacctcagtgccacagatttctctctgcaaacatgtcaggggatgcatttataaacaggagaaagccaattcaacaatcatagttcactgtgaattttgtaaatactgaaaagataaaatagaatcaggacacaaagactgaaattagaattaagcacagaaacttcttgttttacttaatcacatataagagagattattttaaaaaacgtaaaactgtaatgtatctataatgtcataagttccttcactagcatgtgaaaaacttcttcagatatagatctacttctttgtgaaggctagatttcagagaagatgtgacagatctacttcaagaatttggttggggaggaaaagtatcagaattttatttttacccttgatcaaattctgaatgttcagagaaaatagaaggcaggcaggctgtgaagtggaaggaaaatgtgaaagtagtgagaagctctaagtgcaacaaattgcacccagtgggcactctgtaaatgtgtatcaatgatgacacactctaaaagataggctgaatgctacatgctacttagctctaaagacagatttgttacctgtgaaaagttacctgctcatccaaaaataccaattgtggctgcactggaagctcatttcccacttctccatctgaaggctggactaggatggaaagtgcatagggccgaatatatatcaagttcccagttttaaaactgcttgtatttctgacagatataaaaacaaacaaaatacatccttaggattacacatatccctatggtagcaattttccacaatccattattaccagtgaaaatatttgcatttgcctgtgtttctagaaaataatacattgtgtagtgaacatggctttatagcaaaggttaattgtgtatgtatttgatatgttttcttagctataatgaaaatggactagggggtagggaaaatcacaaattatgagcatatatttttatcatcatttattaaaatcagccaaaaaataaaagcctcagtgaaaattagcctcagactaatatagataataataataaaagcctcagactaaaatgacaggacatggacacgtccaatagtaagctattaaatcagcttcccaaataatgccctgatttgtggatgtgttccaattctgtgatataaataccaccaacatagctaattctgagatgacaagataatatcactgagcagagctgggaagagatgcccaacagcaaactccagtacaccactgtttacacagaatagctcatttaatcttcacaacaagccatatttatattttccgagtgtgtttgtactaaatggattcaataactattaatagcattaatgaattaatttacttcagttgcatgaagcatctgaggagaataatatttagaattgatatttactgagcacatactatataccaagttccatgataaagtgttcatatataaattcattgcatctttaaaatgacactatgtggtaggtactcttatttatatatgaagaaactgaggtccaaaaaggcttaaataacttgccaaaggtcctacaaatagtaagtgttgaccaagatctagagtggttaaccaatgacctatattacttcttagttcctttgaacatgttaagtgctgacatgacttagcaacaaaatggaatacatagaaaatagttacataattcatgacagtgtaaaacatatttcactcagagtttcggtatttttgatgacagagcctgcttcattaaaataaaattatatacctattgtcccattaagcctattgtgaattacatatcataggcatgcaacagatgtttggcaactaaatgcagacacctggacatcacatatatatgggaccctgacatagagcaacccttggtgagttatcctcaatagcctaggccaggtctcatgaggtatttatttatttatttatttttaaagtagcctactttgctttctcccattaaatgtaagtcaactattctatttcctaaccacctccccttccccacgtgaggaggaaaggataaagtatttatttaatatggagggtgcatgtcaggaaaaagtgaagatttgttctgaaagaggaaatagtggaagagcaaatacaatggatcactaaatatgaagtttccataggaagcaattttcttctcccctgggaatcctaggaaatgcgggcagagtgcaaacatgtggtcctaagaagctctttagtcatctaccagctaagaccctggctttttggctggaatcactccctgggaattcaactcacactagccccatcatcatttcttagtttgtttagcctgagtggctagggcttctttccttttttaaagggaacaatttaaaccagattttttaaatccatgctattaattctatccttctgtgggttccaggttattagaaaattctaatgttgttatcagatcctatttctcccctaaccttttccttaaattctttctgataggggctaggatgcaggcaagcagtctgggttaaagagactgaaagaccccatcaaagattctcacataagtacattgacgtcttgagacgaagagagggaaaccaactgcctgaacacccgctaaaaggtccattcctgacacactttaaagtttattgtgagcaaacatctcttgttaaatgtaaacagcatctcactggaggtcacagacttgctgctgcagcatatcccaaggtaataccactttaagctccacataaactcttaagcagtttctatcctaaaacctgaccgtaggtggtactgttttttacgatatgttataatagtgcaataaatctgttagcttaaaatcgaatctccgtggccttttagagaaatcatcattaaatgcagggtcctgttaatgatgccatcgaagtgaaattgtttaatctgctaagggggtgaaaggtcatcaaatgaattttttataatacatcaacttgacacgcaatagggaaaactgtaatagataaaagcaaaggaaaagggcactgtcttcttctgataggtcaatagcagccaagagagtcactcatccactttcctttcatgatgggctccttttgcatttaatatggacacccaattaatacctcagcaccacagacaacctcattttaggtgacttatagcaatttctcccccttccctgaaatgaaagtgatcacaatacatcatagcattgtgcgaattaacgttaattgattcaagttaccaagcaatgatgggccacttatataatctaggcgttattgggtgctagaagggatggagggaagattagattccagtgtccgttgctgtgacgacgggagtcacctgatgccttgttagacagttgtaaggttctattgctggccccagtggggtcgtcagtaaactggagtgatgtccaaacatcattacatgctgctccaatattaaagcaaagggattagcaacttattgcaagcaacctggatttgtcattgtgctgtcgttatccaatttccaactgctaatgtgactgtagcctgcaggcagaaggacctacagccaaactttaaaaaatgggggagaaaagttccctccattcatcccagtttttaccattatttaatagcttccaatacccagttaggtatgtgagagatttttttttctgcaatgcttaaatgcaggctataggagaaaagtcaagaaaatacagaaatttcccaattaagagatcactcctattcatgtcattattcttgcttttcgattccaccagatctgaaatgtttaccctgtagaagatggaattatttctatttgcatggaaaactcagaaagcaagtaagttttattagtgaaaactggctctcaacaagacctactgtggtggggtgaggtgaagttggggtggaaatcagagatactctctcttcaaccttcttctcaaagctactaagccgagttcctataaaaagcctcatgttttgattgaatgcttcatgatgtcctgagcattttttatctctcttgttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatctctcttgttttaaataggctagataaggccaaatattctatatgtgccacaaggggacttgaaatataaaatgattttggacaattttgtactctgaaagaaaaaagtaaattctttagtcaattctaaagaattctaaattaaatatattatgtttatatacagggaaaatgcaaatctaatatcaacatatttctatatagttaacaagtatatgttaacccttctactatgtacaaatgttgttcaaggcactgtgagatatgcaaagatatagaacactgtgatctctccccctcaagaataaccttctgtatactttgtatgacaagaatgacttttctggttatccttctgagttgatagatacaattttcttacctttcatggtcctgatgctcccttttaagcctatctaggctttcttagcaaatagccaattcctaagagggaagaaatgtcttatgatctgacggtttttttctggcactgtggtctagtagttccaagcctggcatgttgtaagcacccagtacatgttgttatagtaacacttgccaaatcagtacctactatgcatcccctctgttcttaggtcactaattgcctctgaaaaactaccactcatctttgccttcaacttcacattctggggcactcctcaagcagtgtgcttacttctattctgtgatacttctgattaaactcttgtgattccatggaattattcatttaaaaatgagattccagtaaccttaggtataacttgcagtggatcagaagtatataaagacacagaataaacacggtacatcttccaacaattcaggggacaactacacctcttaggagttgactagctgttaagtaagcctaggtgggtttaacagggcacaaggacaatgaaagataagtaaaatcaattataagcaaaaatcaggggacaaaaacctaagtattttaattggtaaatcatttaaaacaagattttataataaatctagcatgagtattttatctaggagaatgaaaactctgcatttttaaagaccatacgcaaaataatcaaattttcctgtttagcctggggagctgtagcagtcataagtctgtacaggaaaacagaaatcactcaaggtctttctaatggaagagatttaattcaagatattggttgcacaggagttttagaatagtagaaaagtaaaacaggctacctttcactgtatgtgatatattgaatgataatttattgtgatttacaatgtgcttaggcacacttgagaatataatcataagtcgaaaccttgaccacctaataaattttataaagattaacattttatactcaagttaatgttacaaaaaactggattaatggctaagcagcttcatagagaattaatgatttatttgtaatagatacggaatgagatttagtataacatcttctcattaaatagttgaataaatgttgtttttcatatccattaattttcaaatctctagattcttatagggaccatatgatattttgaacataatagctgttcggttaacactggggaataaaaaacattggcatgtaagctttcaagagtctattatatttacctatgagttcactatgtgtacaaataattcttaaattaattgattttaagttagtgtcgtctgattttggacttagaacttttctggatgtggatatgtcaacagcaacaatagattacaattagcatccttttcatagcaaaatagcaaaaaaaaaaatacaatagattacaattagcatccttttcacagcaaaatagcagaaaaaatacaaaccgcaggacaagaactaaagatttagtggtctggcaccattcagtatacgaaaaatagtacccaagggcatcacagcaaaaacaggattgtgaagtaaatgacagatttaatgatgaccatgaatcgtcataacaaatgtgaacagtctacattatttcccattgaataagcctgggtattatgcaatctttgtctttttttaacgattaagagttgaagactttttaaaatgcttgttattaatggaacaatttttaattgtatggaaagcttgcttacgtagaacatctcactttcccacaaagccacacatatgaaataagattacaataattttgccatcgacccaattaaacaaagtagtgaatttgtactgtagtgaaaagaagaaatgatgtaaaaacactctttaatggcaaagttgtgatttttgtcatagggaagaaaagagacaagctggcaatataggaatctcttctaggatgaacattctgccggtctggaaaagaacatacttccttgctgatagaaagattctactctttcatgctccaaacagctctcttctagaaagcaggtgcccaggatacataaagaggagaagatgcagaagagaaaatgctaaaggtgactgaatgccaaaagacttgtataattgattggctttcctggttttcttctctattccaaagcaacctgatagggtgctccttatgcagaatgggggaacttaaaaagctactaatatgataagtatatacacattgcacacacccagacacacactcccacagtgtcatgctcaccctcacagtaactgttttcatggcccaaaattcatggcaatgtcacaaacaaagagctttatgtgatatgccatattactttctattgctgtataacaaattaccacagtcagtggcttacagtaacacaaatgtgttatctccagggagtgggccaggagtccagacaggcttggctgggtttactgaagagttcacttccaaacaggttgttggaagaatgcatttcctatgactacagaattgaggtccctgaaaaaccacaatgagatactatctcatgccagtcagaaaggcaattattaaaaagtcaggaaataacagatgctggtgagcctgtggagaaataggaacacttttacactgttggtgggagtgtaaattagttcaaccattgtggaagagagtgtggcgattcctcaaggatctagaacaagaaataccatttgactcagcaatcccactactggggatatacccaaaggattatttataaatcattctactataaagacacatgcacacatatgtttattgcagcactattcacaatagcaaagacttggaaccaacccaaatgcccatcaatgatagactggataaagaaatgtggcacatatacaccatggaatgctatgcagtcataaaaaagaatcagttcatgccctttgcagagacaaggacaaagctggaagccatcattctcagcaaactaacacaggaacagaaaaccaaacaccgcatgttctcactcataagtgggagttgaataatgacaatacatggacacagtgaggggaacatcacacaccggggcctgttgacgggtggggagcaagggaagggagagcattaggacaaatacctaacgcatgtggggctgaaaacctagatggcaggttgataggtgcagcaaaccaccatgccacatgcaagaagacaacaaatgacaacagagatcaacaaagttttggaagttggaaaacatggtgatggaaacttagctaagcagaggatgcttgaatccagatgcctctagagaaagaccagaagaggctagttcactgtgtattatttactttaaaagtagatggctactccgtttcttcccacaaaacagagttggtagcttatagcttttctttctttttttttttttttaagacagtatctggctctgtcacccaggctggtgtgtagtggcataatctcagctcattgcaacctctctctcccaggctaaaacaatccacctcagccttccaagtagctgggactacaggcatgcaccatcacatccagctaatttttgtgtttttgtagagacggggtttcaccatgttgcctaggctggtctcaaactcctgcgctcaagctatccacctacctccacctcccaaagtgctgagattacaggtgtgagccatcacgcctggcccaaagttggtagcttttgaaagtagctagtactctcttagaaaaatgtgtccagtatggcctgaatttgttgaaatgcatataagctcattaaattaacgagagcaaaccactggagaacatccttggtacttttccatgaaaaaacttaaagtataataataataaaaaaaaaaaaaagaaagaactgcattcctagactcatttctgctggcttaaggtcagttcatgggctcgtcaatggctctccagtgagttcaatggaagacccaactgactgtgatcaaagctgaaagaaacaaggctggctctggagactgtgtcgggctttagggttttgtttcattttggtttggttttttatcatactgtgcaacactagaaaacatgagaaaccttgctaattctcattgaatgccataggatatggcatttcttattcgggagaaatttgttcagacatacttaagaagcagcccttctttatcttcagaagatttactctttgccttatgtctagaaaatgtcttttaaaatgctaaagaaaaagagagagagataggcggatagaacacattccaacacaaaatcaatgctatattatacactttgaactgtttcttattaaatcagaaataactgagtcaaaagtaaaaaaacatgatggctatgacaaatggtgggtgataaataaaagtgatcttttctctgaagctgtttcacttcctcatgatagaatggcatgccccacatatatgtgtgtatatatctaaacttgtgctggatccactctctgctggttttcttctgatgtacctctattgcttctactcattgacttttctctgtttctagttaaaagcacaatattaactgagtcgtcttttatatataatataaaatcagtcattttggaattacgacctattagaaagctcagtactgtaaaatctaaataaaattaagcaataaactgactctctttctctctagacaaaaattattcatgtatgtatacttataatatacttacaagaactcagtgggatctaaataaaattgggcaaaaggaaagatatttcaatgtaagctaagatgcatcagcatcatttctttaagcattctaattctcataccaccatacacaatattataataatgtcactaacatggtgaaggtttggtagttgacaaaaatatccaaaactgaataaattttgaataataataagctatgagtaccttttaattttaagttaacaattcccaaaggccttaaatcaaccagatccagaaaaatttgcttgcattttttctcatcctctttatatatcaatgtataacaggaaagaggaacatccatctctattataaacacaaaaacactagctaaactttcacttggatatgttgctctgtgtacaaaaagacaatcaatgtattagctgaatatttctccaagtgtgaggacgtggttttctttttagttttgctttttatttaagttctaccaaattccacattcactggagatggttgtatagaagtagtcactacccattaaatactaatagcttattagcactatcacaaataaaatgatatagcagtagcaacagaataacatctatttcactttaccaaccctagaacctagcccattgcttaaattcattaaataaataaataaacaatcaaatgaactaaaaacaagttgcttcaaaaatatctcttcctacatgcttttcaccttaaggaatcaaaatataatgttttctaccaccttggaaatagaataatcatgaaaaacatgaatttaatatagaatctaaaaactaagaatttaagtctttaaatgactctttgaatttttattcttatcttaaaaagcagatgagttatatgattcagtgtaagtagattgacatttgcaacatatgtcaatatggacctaaaaaatcagccctcatttggatgtgaatataattagtacttacccatagccaatgactccctttgactgagtaactagtaaggccccgatagtcatattcagaacattctctagtaccccagtctgttgagcagtgatgactcgatgagccaaattctgtaatttgttacttgataaggatgaaatcattccagtgctccttactgttggcgaatcaccaatttcaatgacaatcacttttgagatagtttccacagtcattgggggtgaagccctatgtgagttcatttccatcatgagaggcctacgttgaccaactcttctataatgactagtgcaagtcacagtagggcaattgcgctttctttttgctctactgtcagcaatggcctttaaggtctcttcatggccaggcatctcgtgaataaacctgatttggttttggccaatctgtaagaagttagttagtctttcgagtattactatttcccagcctttttctaagactgaaaccatcacagtgagggccaagtgaatggaaacacctgagcgtatttcaatgggctcctctccttgtaggacaacatacaagaggttatccatgatgttgaaatagttggcaccaatagattcattcagcaataaggaagctgactgaaccagagtgggtggaataaaactttcccctaagaagacgtgggggctctggagctcatggtagaatacagccaagagaagcttggaggtacttttgttccccaatagaaaaaagcgcaaaacttgaggagtttgatccatgaagcagactttggtgatttgcctgatgggtaagatagaatagaaagtagacactgacccagaagtagagcagggaatattggcatttacactgctaaagacatcaacaaaaccactagtcacagatacaactggatataacttctgaattgcccaaatggcatcagcgctatcaagaattaggaccacttggtcagtctgtttgcagatgaatccttgcatcagaaattggtatgtacatttctgttcttctctaaatgtacctataaaagaaaagaagcaaaacaagtgatatatgaattataatctgtcaatgattatttgtaatccatcactcttgccatcatctataactggataaaatatttattaaacatctaattgtgccagatactgagagtgcaaggaagattgcggcaaaatatttttaaaaattaaataatagttctttaatatattttaaaagtatatgttacataatatgttatttaaagttaataatggagataataactgagaaaaggagttgaagaagtaaaagaatcaagacaatgaaataatcattaagggcccttgagagaaaagcaagataaactgctttttactactctcacacactccatataacacaaaatacctcacctctggtcaccaaaatgtgtaggtatttcaccacaccagcaaccaattctccagtggatacaaactgggtgtcacataatttaaccaaattctgatactaaacaaagttagtgcagactccacaaggtaagggctcagtcttacaagcatgcccctatttcagatgccaattgcaagtcctaggctgtgacctctgcttctgaacaactggctatataaatcagggctctcaggactccatccttgaattcaattaactcgctagagaggcttacaaaactcagggaaacatttacttatgttttttcatttattataaaggatattacaaaagacgcagatgaacagacagatggaagagacgcataggacaaggcatgtgggaagggcatggagcttccatgccctctgcatgtgccaccctcaagacacttccatgcgttcagccacctgaaagctctcccaatcctgtcctttcagcctttcatggaggctccattatgtaggtatgattgactaagttattggttgttggtgatcgactcaaccttcagactctctcccttcccctgaaatggggatggtgaggagatgaggcttgatgttccaaccctctagtcacgtgattggttcccctggcaaccagcctccatcctgaggctatccagtagttgaggcattagctcattagaaaaaaaagatattcctatcacccaggaaattccaagggatttaggaactgtgtatccaatgtttctgtcacttagggaattacaaatatcttagggcttctgtgtcagcaaccagagtcaaagatcaaatattcgaacaaaagagtctcctagcactactgattttagtagctctgcctcaggaaccagaaatatagatacagatatagattagatatagatatagatatatagatatagatacagatttagatagatatagatatagaaagaatctcacaatatcatagctccataatagaaatagggtataagagaaggggtagtaacatccaagcgaatgggagaagaggtagatggaggggaatgggtggaacagagaaattatgaaggcatattaaaattgaagaggtgtgtctgaccagattgtgaaagagtttggatgtcaaactatataattttctcatactctatttttccctaaacataaaaagtaaagaaatacaagaagaaggaaagaagaaagtagtaacttcggaagttgttgatattaaagagtccaagttgaggatggtgagggttaataaaacatttaaaggaacagcgttattcattatttctaccattcctaatacctcctatatgaacccagaatagttcttgttttgaatccatagggatattttatctttcaataaagaatttctttgatttaaaatttatattcacgaaatcattctgtattgttttctagatttttaaaatttgccttagtgtaagttcataaaagtagcttaagaaatggaacaaaaaatcaaattatctttaatgtaggaaatactagatttgcatataatctagtctttcctatattcttccatccatatgatataattataaatctatgctaaacctgaccatggtgttaataaatttaactaccaaattgttggttcagaagtagggcacatgttttactttttcttcaacaataacagcaaaaacagggatgattaaaagtcacaaggaaaactataaaatatttaaaacaataataattatacttttactatattaaaatttggggaatgaagttaaaacagtacttttatgggaaaatttatagtgttaaatgctcatataagcaaagaagaattatctaaaagcaatgtcctatatggtactaccttaagaattttgaaaaaagatacaatggacagcatggtgattgcagttaataatactgtatgatataattaaaatttgctaagggggtagatcttaacatattctcaccacacacacacgcacacacacatacaagtaaaaaggtaataatgaggtaatggatatattagttttcgcaatgtatatgtgtatcaaaacatcacattatatagtatatcctaaatatttaaaatttttatttgtcaattatgcctcataaaagctggaaaaaaataacagaactgcacgtcaaaaattttttaaggaatttagaaaaagatcacagaaaagtcaaagaaaggaaataatcaatatgattgcagaaatcaatgaagtagaaaagaaacaacaacaaaacaaaataaaacaatagagaaagcgattcttggaaaacagcaacaaaattgactaactcttccctagaccgatcaaaataaagagaatacaaatcaccaattttaagaatgaaaggattatcattacagattctgcagaaaaaaaagagaaactattacaaacaaacatttgccaacacattcaacaacttaaagtagacaaatttctttaaaattgacacaagataaaacagaaattttgaactgttctatgtctcttaatgaaattggattcattgcattgaatgctaaaaattaaataaaaatttaattatcaaatttaaaggaatagtctcctttttttaaccttcacattgtgtttttttccctgtgattatatcataggctaactctaatgttaagagttgtcttcagaagcatggatccagtatgaaggcaaattaattacatggtcttaatggccctagaaattttgttttgagatcctgatgcaccaatctctactacagttatatcttttccaaataagatagttaggtaacatttcctcatgggaaatcctcaaatcacagaggttccccttttctaaacttggcagctcactctcctttttacacatttttttcagccatgctgatgttattgattaatcactcacattccatccaattttataaatctctggctttgttcttcctacttctcatctaagagatataatgtcttaaagtgacctctaaagatgtacagttctgttataattataaataaataattaaacaaaaacaatcacttcctttgttgatgattctcaatcattctctgctaccatctaactgtatgtaatttgataaatcacatgacgttagtaggcatcagtgttcttaagggttatctcttcaggtcagggacaatatttcatctctaaatcaccacaagggtcaacattctacctcaagcacagtagatgcttttaatatttattagctgattgatatgtaatgtccttttcaaaattcctattcttcaaatcactttatgtgttcttgtcaggtgtctaattataagactcttactctatagtacaaatatattttaagtcaactcagcataacaataataattgagtatatcacaaaaatttattgtatcatcctctaaattgattcttaatatatgttaggcaatactgtaatacatctatttcacatgtatccataagattgaaattatggctgactatacttttataaattttcttctgctattgtatctcatagttgatttgtccacaacaggttctgttgtaataaagcattttgggaacaattcatttattcattaaataaatacacatgggtggaaaataagtttttctttcatacctccattccttatgacaggtaacttccaaggccaaaataataaaaaatggccttttaaaatgtaattaacatttttttggagtaataaggtacaggagttatactagtaggatgtataccttcaaagaggcccattattacttatttatttatttttacatattccacccagaagccagtctgtcataaaggctggtcacccaagccatttctgcctcaaggatccaaagttccccattccactattcagtcatgacactggatgaaaaagaatatgacaaactacctaggtagaaggcaggcacttgagagggagagaaggagacagagggagaaaagggtttgaatcgtgcagggttggagcccgagagggcacaatctctgctgaaagtgtgtgatgcagagcccttgcacaccctggagagtttagcccaggaccggtccatgaggaaactcaggaataagatgacagagaatgaaaattcacaaatctttatgacccattggcattttgtatgaatttaattacaaaccctagattgtggtaaggaattggataaacatttatttggattccttgtgcatgcagtaagattttgttactatggctcctctctctagttgccatattgttattattaagcactgtgttaaaactagagatcaaatgccaggcttctcaactatgtgttagttatttgcttgtttaaacttagccaattaccttcctgattgcaaaggaactagtgcagtgccaattacacgcattatttttattcctattttctcccatttttatgttttaaacctctgtgtatgaataccttgctgtgaaaggaccacatggattttgatttctcatatctggttggagatttacccctatgaccttcagaaagttaataattagtatcttcttatttaaataaagagtttcatcaaatattagttattataaaatattctcatcattctttcctttctacactccccaaaaatgaaaaatatactcattttgattcaagataagaataaagaatatttaaattacttctttggttcagatcttcttgacaaaacatacaacgaacaagatatcttttctccagaatatactctttacaattttttctaccctaggaaaaataccgtacaaaaaaaatctgtaataaataacaaattagttatatttcaaggctatgtagtcttgtgacagatatactttttctagcccaatgtttctcagaagtcagagctgaggtttctttgttagaaatatgagaatgatgattgggatgtgactgccccaaactctttatagagatgaagctatatacaagtagctttagccactgaggggaaaaatgatttgtatatcagatatattattgtggataagtagaaaattttccttttataaagaaagttaaaacagacccgaaaaaccccacaaattaaataatcccaccaaacaattagtcatctctgataatacaagcctatttcagcaagaatttttaccttagagttttgacaataaggattctgtacaaatgaaatgccctacatgagctgaaaagtaggttcttttatctttaatgttattggaataaaccagtctaacactcacaatgaaattgtgagaagcagctaatgcatagatgtaataattcagagtctcttaaaatgtacatttcaaaaaggtagattgttgtgtttagatgcaagctgaagtgctgtagataagacagaactcataaaaagtgagaggctaatgttggagggagtggatgactgacacagtaagctctctgagaggctaaggaagaacagggtccacagccttcttaaataagatgggattggataggttgaaagacttcatctcccttgaagcaggaaggagggcagagagtgtaagcacaggtggaggtgggtgggagattgaaggcactctatctgctgggaggtgtgaggcaagcacggttatcaacaggaagtcaagtatgacggtgagtattgggggctaagatgaggggcaggaaagttgggtcaaatgtttgtggactgagaagatggtataaaacagtcattgtgaaagaggtgcaaactcagtctttctgttactttagtgcttatacaatgtgagggaaccattccataaaagtaggtacaaagatatcaattcaaaatttggagtgggaatgaattatttaaaatgagaaaaaaatcacaacacaattatgttttaaaaacctcgtaagtaccacaaacatgataaaatctagggaaaggtaatacatatactacccagcttacctctgtatcatccttcctatattttattgtaactgttgtattgcttcttcatataacaacaatgttgtaatattttttatagagaagacagaaagataatttagtattttctatagcttggatgattgacgtttgttttccataatttcattggtagtttagaagaatttgtttcagcttcgcaactcattattggtatgtgcaaatgtttataatttttttttaaatttattataatactttaagttttagggtacatgtgcacaatgtgcaggttacatatgtatacatgtgccatgctggtgcgctgcacccactaactcgtcatctagcattaggtatatctcccaatgctatccctcccccctccccccaccccacaacagtccccagagtgcgatgttcctcttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcacattttatggctccatagtattccatggtgtatacgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtgccaccaacagtgtaaaagtgttcctatttctcgacatcctctccagcacctgttgtttcctgactttttaatgattgccattctaactggtgtgagatggtatctcattgtggttttgatttgcatttctctaatggccagtgatggtgagcattttttcatgtgttttttggctgcataaatgtcttcttttgagaagtgtctgttcatgtcctttgcccactttttaatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtccattttgccttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatacgcggcgttatttctgagggctctgttctgttccattgatctatatctctgttttggtagcagtaccatgctgttttggttactgtagccttgtagtatagtttgaagtcaggtcgcgtgatgcctccagctttgttcttttggcttaggattgacttggtgatgcaggctcttttttggttccatatgaactttaaagtagttttttccaattctgtgaagaaagtcattggtagcttgatgaggatggcactgaatctgtaaattaccttgtgcagtatggccattttcacgatattgattcttcctacccatgagcatggaatgttcttccatttgtttgtatcctcttttatttcattgagcagtggtttgtagttctccttgaagaggtccttcacatccttgtaagttggattcctaggtattttattctctttgaagcaattgtgaatgggagttcactcatgatttgtttctctgtttgtctgttgttggtgtataagaatgcttgtgatttttgtacactgattttgtatcctgagactttgctgaatttgcttatcagcttaaggagattttgggctaagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccaatttttgcccattcagtatgatattggctgtgggtttttcatagatagctcttattattttgagatacgtcccatcaatacctaatttattgagagtttttagcatgaagtgttgttgaattttgtcaaaggccttttctgcatctattgagataatcatgtggtttttgtcttctgttctgtttatatgctggattacatttattgatttgcatatattgaaccagccttgcatcccagggatgaagtccacttgatcatgggggataagctgtttgatgtgctgctggattcgttttgccagtattttattgaggatttttgcatcaatgttcatcaaggatattggtctaaagttctctttttcagttgtgtctctgcccagctttggtatcaggatgatgctggcctcataaaatgagttagggaggattccctctttttctattgattggaatagtttcagatggaatggtaccagttcctccttgtacctctggtagaattcggctgtgaatccatctggtcctggactctttttggttggtaagctattgattattgccacaatttcagctcctgttattggtctattcagagattcaacttcttcctggtatagtcttgggagagtgtatgtgtcgaggaatttatccatttcttctgtattttctagtttatttgcatagagttgtttgtagtattctctgatggtagtttgtatttctgtgggatcggtggtgatatcccctttatcattttttattgcttctatttgattcttctctctttttttctttattagtcttgctagcggtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgagtcccagagattctggtatgttgtgtctttgttctcgttggtttcaaagaacatctttatttctgccttcatttcgttacgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaacaggtgtggtgtggtgctgaaaaaattgtatattctggtgatttggggtggagagttctgtagatgtctactaggtctgcttggtgcagagctgagttcaattcctgggtatccttgttgactttctgtctcgttgatctgtctaatgttgacagtggggtgttaaagtctcccattattaatgtgtgggagtctaagtctctgtgtaggtcactcaggacttgctttatgaatctgggtgctcctgtattgggtgcatatatatttaggatagttagctcttcttgttgaattgatccgtttaccattatgtaatggccttcttcgtctcttttgatctttgttggtttaaagtctgttttatcagagactaggactgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagcatttagtccatttacatttaaagttaatattgttatgtgtgaatttgatcctgtcattatgatgttagctggttattttgctcgttagttcatgcagtttcttcctagtctcgatggtctttacaatttggcatgattttgcagaggctggtaccagttgtgcctttccatgtttggtgcttccttcaggagctcttttagggcaggcctggtggtaacaaaatctctcagcatttgcttgtctgtaaagtattttatttctccttcactgatgaagcttagtttggctggatatgaaattctgggttgaaaattcttttctttaagaatgttgaatattggcccccactctcttctggcttgtagagtttctgccgagagatctgctggtagtctgatgggcttccctttgtgggtaaccagacctttctctctggctgcccttaacattttttccttcatttcaactttggtgaatctgacaattatgtgtcttggagtttctcttctcgaggagtatctttgtggcattctctgtagttcctgaatctgaatgttggcctgccttgctagattggggaagttctcctggataatatcctgcagagtgttttccaacttggttccattctccccgtcattttcaggtacaccaatcagacgtagatttggtcttttcacatagtcccatatttcttggaggctttgctcgtttctttttattcttttttctctaaacttcccttctcacttcatttcattcacttcatcttccatcactgataccctgtcttccagttgatcgcatcagctcctgagggttccgcattcttcacgtagttctcgagccttggttttcagctccatcagctcctttaagcacttctctgtattggttattctagttatacattcttctaaacttttttcaaagttttcaacttctttgcctttggtttgaatttcctcccgtagcttggagtaatttgatcgtctgaagccttcttctctcagctcgtcaaagtcattctccgtccagctttgttccattgctggtgaggaactgcgttcctttggaggaggagaggcgctctgctttttagagtttccagtttctgtgctctgttttttccccatcttggtggttttatctacttttggtctttgatgatggtgatgtacagatgagtttttggtgtggatgtcctttctgtttgttagttttccttctaacagacaggaccctcagctgcaggtctgttggggtacccgcccgtgtgaggtgtcagtctgctcctgctggggggtgcctcccaggtaggctgctcgggggtcaggggtcagggacccacttgaggaggtagtctgcccgttctcagatctccagctgcatgctgggagaaccactgctctcttcaaagctgtcagacagggacattttcatgtttagaatttttgtcaaatgtgggaagtctcttagaaaggttttctcatgtatgagctgtaatacttgaataaatgttcacagagtagcttttattggactgttaccccaatcctacatctcttatacctttcactttctcctcatgttttagattatgttcataacacagtgtgacctagggtctggcttctgtgtgttgcaacaccgggtaagtcgacatagatgtctagtaataattttatatagaagtgattaggaaccatacaaatcacaccctactaagcccaaatcaaatgcatgtccaactcagtttccccttagctagatttcaaaaatgctgtagctagtccactgtcactcaaccccacaccacttatgatgaaggaatatttagagtggaaagagagaattatcctaattctggttaaaatatcttaattttgaaaattttacaaaagcacagatctatgcaaacacatagctgagatttgttttggagccttgcaaggggcgcatgtaagtgaagagcctgaaacctaatctttatcatcttcacagaaaatttagtctgcccgtgttgtggagaatgtatgagtacatgctttggctatacccagtaagatggaatggacaaacagaatggctgagtttattcaaggttgggttcatgcctggctatgccaaggacaaagagtcataggtattaaagttatatacaaagaactgatgataagaaagcatagctcatttcagctgcataagaagggaaatgaagggaaggcactcatgcatattagaaaaatgcacatggcaatgagtttaatgccacaaggaaggggctcttgaacaatttgagttggaaagacctgaattattccttgaaagtatggtacttaagttcatgattttgaagttcagtgatcatgacaatttcaatgttatcactgtgtcagtgagtagtaaggtactgtgggggaaaaagcatacctgatagaaatactaacagcaatggctaacatttactgaagaccttctctgtgtctggcattcttctagagaggacttgaagatgatatgaacaatgagagataatatataaactgacaatatctaggccagataccaaaatagaactctgaccaacaaacagcagtaaccagtcctagaagaccaaataataacccgtgaaacaacaagcctcaaacagccagtacttgattaataactgtcagcttccgtgttttccctgataattccccaatttttgcctcagtttccaacttagaaccaattagagaaagcaaaatatgtatccataaccaaccacatgggatgccccacttctagtttgactgtgtccagcttccccatgccaacagcattaatcaaagcattaacctgaagctttcccttttttccactataaagctttcctacttttctgtgtgcctttgcatctctaccaaattgaagttatggtggccgactcacttgctatagcaagttcagataaatagcaattgccggttctttgcatagtctttgtttattttcttagcagtcaaggttttgaatgagttagccaccttaagaaaatcacgaaagagttaggatgaagaagagaacagtgatccagtttctttggccttcagggagtgaagagccacgctgattatgtcaataagactcatgaagcaggtagtcagccagatggtgtcagcctcggaggggcaggggttttattaagggatattatttaggacatgggagcagcatggaaacatgaaagacaccttaaggattgagtgtgtggcttaaagaggctttaaaaagagtggaatctttagaagatggctaggttccagttgaggtaaatgagtgaaaagaaggttctttgaatataaagaagagtttgctgatcccaagtacaaactttctcacagcaccaggaacaacttttggaggaacggagtaaaaggttgggtgagctcatgaatggattgggaaggagatgtgtattctagagatggtagatagagagtggtagacatgtaggtagtgactgaggaaagctgggatattaagaaaaacatattgcatccttatactaacagtggtgtaaaaattagggactatcagaggagcctgaagggtttcccacagtttttgtcaatgggatgctctggtatactgcttaaggagatcttatgtggcaggatggtggtcacaccattgtcatttcagctatcacataatggttgcttaggagagctgtaggtacagatatatctgttaagaaacccacagactaacgagtgtggtgcttggaagtgggacaggccaggatagagattagaatggcaaagaagaagctttgacttcactacaaagatgccctcaagacataaggttggtggtccttccttcctcctttccttccttcttccttcttcaattcttcttttcttccttctctacttcccttccctaaaactttctaatagcaagtttaattatccatagttcatagagaaaaaacttgagccacagcaattttaactcagtataattacttagtagtaatgatgaagatgaggaagaagaaaaaaagcatatttctaaacttctacctgtccctttggcaaagttaaatgtagtctaaataactccccttttggcctgtgtttagacttaaggttcagggtgatgatttatcctgtgagaaaggggctgtaataactagaagttctctctgcacaatttattgacaggcacacatggaaaagtgtttgacgatttgtcaaatcacatatttgcaagagtccatttgctgtgttatgtcttcatttggcccttttaatattttatcatactatcccaggagtataaagatatagccacatatttagcaaagacaatagcctagggattatcaacaagtaatattaattatccacttttgtagccagacttgaaatcctggtcttcataaattaaaaaatatatgtattttttattttttcagagtttaccaatgactaagagatggggtagtttgtcagtatcttattcattttcctaggtcacctttaatcaatcctcctattttaattttggcgtgaggcaaaaataaagcacacgtaagcagggttccagagccaccaaatgggtgtagttcttaattatggcagagaatacacattaactacttaagagggtgacagacttcagagctcaatcctcagccactactggcaggagcctgcagtgacagttcagcatcacttctatagagcgttccatttttccttcctctggatttgttttcttcctgcttctgtcactcggggaaggtttagttttgagtaatgattatctttctcccttgtttttgtcttttcttttctcccacttctccaaatggcctatctgccagtcacaatttttgtggtctgcaattctgatcatttttaaatgaaacccatgctggctttggtaatcataatgtcatttacaatttaccactaaacacgtttattcagttagtagcacactggagaaagagaactccatatgaactcaccgtgaaaggcctaatctgattatttcctcatgaaaatccaggcaggggtgcttgtaagaggggctgagagaagaaggaaaaaagcgagatctggccacagctgactttcataatcaatgtgaatagataagtgacacagcctgtcaggggcagccgcccagccaccccagggcattcctttccaaaaggctagggtggacagggcttaataaatgctgagtgaccagtgagtattggcttggcatatgctattgcatacacgatggacaagaacatgataaagtccagaagctcttctctaagtggggaaaattagattaagcaggttgtatttgtgtgtgcatgtgtgcctatgagcacttgctttgtgtatactttaacttcctaaaataccctggtcattcagtatgctctgtccacctttccctagacaggaagctacagacgtagaaaccaaggcagtgagtgaagtctgtctggtggcagaggaggaggaaggaggcaggtgtgtatgtgtgtgagtgcatgtgtagattcaggttgcttccagggttctaacatatattaactttgtgtcaatatttgtccttcctgtcgtgaaatgaggattttccacctcatttcacgtttgaaaagaaaatatgccaaaggggtcgtctttgctagaaaaaaaaaaaaattaaaagaaaagaaaaaaaaaaacttctattctttatttagaaaaatggatctgaaggaaagaaaaaaatttaaataaatgttctgactcaaatgcacatagaatccttccatatttctgttttcaacaaaaaagaaaaatttatatgtttaaaattgaatgaaatacatcaacattaatgattttttccttgaggttaacaccaccatttccctcaataatttttttagccattttgtaatatatttcacaattcatggtaaagtgtaggagatttgacaaaaacaaaatatatactcattctcttattttcaagaaatgaaatcatttacaattcttttgtggcaaacaacatttatacctcatttgatttctaatttaacaaatataaatggtcccagatcaaataaagtgaagacaggttgaatttatccccatttatatatgttgtcacaggccctcaggctatgaggagtgaaactccaaaatctcaaagctgtgctcctcaatacacaaaagaagtaactgtgatcttccaaagaattattaaagaaaatatgttttggtcataatagaaataatagagaaaaactgtctgcttttctagaatgggcaattctaagcaaaaaatcatttgtttaaacttcaaaaaaatgggtgtatgttacacttataaggtgaaggcatattgagagtgatgttcttaagcagaatagattcaatataggtgataggaaacacacccttgctaatctggagtctagaattagagctacttaaagtctattgagggaccataatatggtagttctaattattatgaaaaagatatatatgcttgcacatatacacactgataggaattattataaccaaactaagtacaattataatagttattattacaagtaatatgagaaacttaaagttcattagattgaagaagtacaacatgtattcactcactgcttaggtcctagagcttcaaaattaattcattttcagattgcctttcacagtttgttagacagtggcccttcagagtatagtcacctctggcaccattttcaatgaggaggatgcactctaatagctagttactggtgtagtgaagtggctttcaatgctcgggagccacaaaacgcccaagagtgaagacagttcgaaaggactgaagatactgcctaagaacaggaagctgctgtatgaggaatatatgcatctgcaggtgtaaaatgggctggtagacttcaggaactacagatcataggatctgtcacaattttatgagcaatctcgccaaagttttgtagttgggcctattttccatgaggacgcacttccaaattaatacaagaaaaacggaaaactacataaaaccagctattgcatgaagcaaaaaatgtctgtaagactttctgttaaaggcctttctgtctctacaatcagttctttcagggaatatctcaaaatatttgttctcttttaataaaagttgttgcattgataaaaaagatcaagagatgaaagttaagtgatggcatgacaatatgagagagaaggtcagatctatacccaatagacccttcttctgattcaaccatttttcctttttacttttttaaattcaaaaaaaaatccttacttttattagtagaaatctgttcaaacaaattcaatagactattttataattgttttactagggtaaaatgtcatcatctatacattgcttgaaaaagtggtttagaaagtgtttttgtattttcgttattttgttgtaatatgttttcacctgaaaacatcaaagaatatggtcccaattatgattttattatttgaatattacattgaaaacagcccaggcaaattcaaactcaggaagtacagcttagcgagtgggagatcagattttaaagtcagagagacttgcattgcaagctggctctgccactttctagctgcaaaacacagacaagttacttatcctccctctgaatcatttttttcattgtcaaagggattggaaatggtacttaattcataagctgatggagagggctaagttagatgacgtatgcacagagtgagagaaaaacacatgttaataaatacaagctgttacattcctataattttaaaaagagaatttttaaagctaccttccagtctccttttgccttttatggctctatccttatctcaaaccagtgtttgtctagtattctggaacagcacctgaagtgttgcaaacattcataataaacactgttgaaagagacaagttacaggtgaagaaaatgctggaaggtagaaatgacaacctatgttttcaagaaaatatcagcaagaaagaaatgcacatacataagtacatatacatctgtgtgtgcctgtgcacatgtgtctatgaatagagcacctatattttccaccaatcaagaaaaaaacccaacctgaaaatctaagattattttcctgttcatctattcttaactttctcttcatttcttttataatataatattcgccatcatcaccctacaccttctctctaccttcttactttttaatgttaattttatttatttatttatttagctagctagcaaatcttgcctgccagctttaaacaaactgatgttcatgggttaaacacaggagcagccaacagcattctttgcagatgcaattcctggcacactctttacccagaatgataaacttatcacctctccagccctcagtttgaagctgcagcagtaatttctgctgggtgccaaaactaaaatgaatgtgactgtgccatgccctgctctgagctgtggctataatgagatttgaatgggaagccccggacacaataaatctgcgccatatgtgaccatttcctgtgtcagttcctttctcataaccagtggagaatttttttccctctcatgaccccacaccatgactctgaaatctttcatggctgcttatgggcctcaggctttttgcagcagttgtataaataaatgaatttgacagcaaacatcataacagttagcagtaatgtgtgttcgccacaagtgcctatactactcactggagaaatggcacaggaaacagcttgttttgttacctaaacaaaagtagtttcgtttgacaagtggtgaaagaattagtcaaataaacttgaaatccactaggactttttttttttttgccaactctccctgccaggggaatgttcccagctcctgagtgcccatgactcacagaaggtaaatttctccctttttattctgagataaagatctgcactgggaatacaaaaccttcgactgatattttatattaatcttttcaaggcaagagtgtcatgcatgggaactcaggtagtcaagaatttccaaggaagcctgtggtagaaatgccaagcaggatgtttcgggaggaaaggaaaggtggtaataatgacccaactcggtgattcccattgaaagcaaattgaagcttacaagtgcttcttttcctttcacactgcctttattcaggaacaaaaaatctctacacaagttgctgaaggaaaggaaattagcattttctctgcatctcatttctccacccttcctctggcatcttaatgccaatcctgttgtctctgctgtgaaagatgttataccacagtgattattctcaggactctggagcaaactgcctaggttcaaatcctggctctgcttcttaccctctgtgtaactctaggcaaataacttggcctcattgcatctcagttttctcctttgcaaagtaggaataataatgctacggtatcaagctcctaaggtgtctgtgccaattaaatgtattttaaaaggctcagaacagtatctaaagcataatatatattattattattattatgccaaacagagagatttggaaaatagtctctctagcagtactagaaattttttccacgatggcttgatattggcagctaatctcagaaatgaaatttaaaactttttggggaaaatcataataggagcttcatgtaaaccattacgattaatttcaaggtacagtacaacactacttgaaataaaaatatcacctggaccttgaaattttttcttatatgaaggttattttcacacttttaaaggtgtttacactttatcataagtggccaagtaactattgcccctagaatcttctcatattgcacagaagtatcactgattaggagagcaaaactcaagagttatcacaaactaataaatcttagtccaggtatatgttctattttggttttggttttgtttttaatttaattattaaaatgcattcactgaagtattttgcttgtgtgacaattacaagaaagtgccataaaattttagaaggtatggacagtaatcaacatgaacaataatttcctattacagacagcctgctacctacactatagattcccagtgtctttattttaattaaataaaaaatccacttgaatatacatttctccatatttaaacttccagactatagtgaaaagtcacaaatataaacaaattaaactattgtaaagataaatgaacggttaacgttttgctctgagagcaatgccaataaaacttgaaagggtgttaactgagggtaaaaaaaaacatatgcctttataagacaatgaagaaccagtagggggacagaataaatatacagttaaaaatcggttggttgtgaattggggttaaggattgacagaaaaccaaatacataagtggcatccctctattgtaaagcaagtttaagtacaactccatttctagtaaaatcaatggaaaaccccattttgtcactgctgcccatgtatagactgcattgctacatctaggaaacctctcagaaattgatctatgagaaatgactttttccccaaggcaatttcactgctgtggaatgtcatctgataaaatggctcccttgctacttccaaatcctttcccaagatcagcttctaggatgtatttcctaactcaccttaggatttccaaaggtgaagatttaatgctgtgaataactccagctcttcagaccagacattgccaccaaccctgaataaacacaggccttagcaatgtcatgtttggttgaccaaccactgctattgccccttaactagcaaataaatactgccaccttgtaaagtctgtttttctgagttaaagagaacactgaagggaatagatgaactttaaaagaccagtagccttaatcaagcatgtagatctgtgaaaataactgctcagctatttcttcattgttttccttgtatgtgtgtgaatacatataagcctagccttgcacttccccattatcttattggtatcttaatgactagttaataggatcattaactagtcattaaccattgagcagaggtaactagtgtcccttttgggccatactatttaattgaaagaggtggtgaactacaagccacaggccaaatcaggcccactggctattgttataaacaaaattttattggaacacagctatacgcatttgtttatgtattgcctatggctactttgcactacaacagcagagttgagaaattgtgacagaaactgtatggcctacaaagttaaaaatatttgccacctggcccttaacagaacatgtttgccagtctctgttctaagagttctgagtttgtctcttgagacagtgaccagaaaagtatgagatggaagctgatctttcagcttgagttcctgccaaccaaagatggacaagaagtacaaacgagaaataagcctttgttgttttaagctgttgagatatatacagcatcagggtagactaggttaggatgtcagtactctgatggatgcagcatctataatattcttagatgcatcttttcctccgaacatatatactatctcctgcttcagggaagaggataaagaacataagggaactcttcttttgtccccaggagacctaggatgaaaacagaaacataacacaattttctctctaaacacaagttttctttacataatttatcataatattcactttttctaatacctgagcatcagtattctctgttaaagctctttgtaaaactagttctatgaatctcttcaaatttgccttcttttccagtgtgatataaagatgaaatttacttgacatactgcgcacagattactgaagtaattaggtaaaaatattttcataagcccagaattgggatgctctagtctctgagaatgagttattatatttgggctttgctttaatatgggtgaaaaatgcacacagctggctctgcttgctcattttgctatgtccaggtcttctcctttggaggaaaaagaaacagggcaagttgagtgaacagcttgcctctgcttctgctttttggaggcagaaagtgatggagaccaaaatgagagtataatgttccttgtgtcagctatagaagggaaagcctaggggagtcttaccaatagaagctctgtgacctgaggaatagaaacagtagattgaagtgtcaatttcagttgattttcttcctaatcctgctgactttgaaaacagacaggctaccatgcacctcagtttccttattatgcatacaaagcaatatacctggatacttacctaatacagggagaatacataaaagttatttgtactaatgtctgggagacatggcaggggaaaatatattgaaaaaggaggcttttacccaaacaatcagctaactagcagtaataaataggatccagaagaaagagtgaataagaaacatggtgagatcaaccagataccatttagtcagttgaacaaatcaactatgaagatttttttacaaacaaatttgctagagttcttacaaataagattctggctcagaggatttcaggtaaattacttctaagttatcctttaagttcaatgactcctcctgaaaactgatgtatcataattcagcaaggtgagcaaattttaaggacaattcgggatccaattttgagtcagaaaacataactagattacagagatacacaattgacactaaacactgggagacagaatggcttacttataccaaaggctttattcaaactttgaggcaaagtagtggctggaactataagaacaaataccaaaaaatatatttacagatgccaatcagacaacaaacacaatatataggctcaggatgggaaagtatacctgattaagcaaaattgtaccttattttcaaccatatataaggttaaagaactataagcagctgtgtactatggtctgcatatagaaatacttcaggaccatctcttcaatttggatgatgtatggcatagactcaggaaatcatagtaatcctaggttttattccatcacatcagattttggtaaattccgggggcagtgtgagtaatacagaggaaaaagaggaaagaatgtaattttctagctcttccattgtatagttgtgatattgtaatcattgattttatactatttattgaccatttgccattatcctgataatgaattcaactttgagattataatggttaaaaattaaacgagagacacagtgtttgccttcatggagcttactcagtcatgtttttagaaacaaattctccttctcttttagagacaatgagctcatgagcaacttgagtacagatatcagccttattcacctttgcatatgtccttctgctcccatatactcaaccagtgcccgatatacaaaccaagagagaagaaacatcaacatttcctgagtatgtaccatgttccagctattctgaaagtctttcaaccaacagttcttattttatttaattatcatagcaaactgagcggtgtgtttttattgcttccattttccaaataagaaagttgaacttgtagctgtacttgaaggactgtgagataacagaactaaatgttagaagcagcctggttccctgagtcaccaccaggagggcagctaccaggagagtcacccaaccttcttcaggctgagatgtgagtaaaacaaagtttttctattcttaaacaactgagatttggagattatttgttaattggagtaactctgtctcatacaatatccatgttttatgtaaataaagaaaatttaaaaagtaagtacatacagagaggcaatgaacaaataatgctgaggtcccagttagtttagaagcaaaaggaagagaaaaatacaagcaatctgacattgtgacctacactacagctaccatttaaagaggctccaaggggatctataggacatcgttgtcttcattctgtgctcttggaagttcactaagaaatgactgtggataaggtttgccctgctagatattcccccacttgatggccagcttaaaactgatttagaagattttagagactgctagggattcacagctttactaaggtctgaaaagcaagcacttaagcagcatactgcatgccaagaaacaaaatcagaaggtacaagcagctggtttgacctttgagaaaagtttggcaaaagggcaagagcatatttataactcctatgggacagttcatgtgctttccattggacttgctctgtgtcaaaggccaatttccatccattatgattcactaagttagttttatgaatattatgtttagagaaaatcacacactgggtcaaaagcaaaattagagcatatccatcattgggaagtttatcatttcaccaactataaaattctttttgcttgaatttaaggctgattttccctgaaatacatgattttccagataaaactagccactgatctttcaagaatagttttctgggtcaatagaagccgccttctgggaaaatattacaccccattacacatctggccaattctttgaggccattcaaactgttaggagtaagagtgggagaattccttcctgtcctctgagacaatcattttataccccaaaacttcaacctcgttattcttatcttagggcataattacaatgttattattggtcataaaattaaccagattttcctctcttttcttttcctcttcagcatttgactccctgaccttcttcaacagaaaagtctatgggctgattatacgctaagaatagaagtatttcctcttacttgttttaaattttcccactgttaatttctttgagagcatacttgttctcatattacaaaacaatgttaaaaaaaatttttttaaagaatttttactacttctataaaatctgaaaatttttgctcttgtatcccagtgtttctgagattggtccctttcgttatctcaccatccagaggtcctagcctacatttacgttggcctatagttacatgattcaacttataacctaaggccccttgccagttgctccctgcacttcactttactatttcccgaagcaacttctttgttttagttgaggagggttgctaccttcctgtggcagtggttgccaaagtattgttttaagaatcattaccaggccatgtaaggacttggtagaaaaaatggttttataggttagcagtctgctggtgtgaggggtggaagatatggtggagccttggaaaactcactgtcaggaaaacacagctatacctcctatgcagacactttgctcaacagcacttaggcacaacttacctgctgtctaacccagaactccatccaaattccattccacttatccacgtctgacacttcttaagtttctataaagatttttctaacactctttctctgctgatcactggctgacaaaattcattctataattcactctgaaattgacagcattgtcctagatggatggcatgcttggatgacagcacctaaatcttacctagagattcaaggtgagaaggtttttgaacccttaactcatgttcaccttgtaaagaaggatgatcatccttctactgtttatattaaaatgattagacttggtaatctttaaaaccacaacaaaagctggacttctttccaaagaaccagaacgctttacctctgactttgtcttctgctaattcccttcctggtcattctgctcaagccactctgacttccttgctaatcctcacacactgcaggcactctccccacttggggactctgccaaggcagatctctctacttttctcccaggtgttcctgtggctcaatcccacaccctcttctctgtctccttctcagtgaggcctactttggtcagcctatgtacaagcattctttttgctttctatgatgctctacattttttcttttgtctatagcacttataactttataatctactagagaatttacttatttattatgtatattacttagtcactcctctaagtaagctaagaaagtaagccctatgagagcagggttatttgtctagttttgacactttacaactagccagaaaagcaccaggcacatagtagactcagtaatatgtgttaaattgaataaacttaatgcatccattcgttttcaatgattaactctagaattttcctgattcgctcagattgaaattgaacattcaagttgaaactatgatctactcacttgcatgtttgaaatctacaaggacaactttctaaaaatattttgcaaggactgtatatttcatatgtctttcagaggccagatatgaagttacattttctcaggtactccactttctcttggttttcagaaaagttgatgttcttgccctcctgaaatcatggcaccaaaaacggggatgtaagttctttcattgtcaagagtgaatgagaaggaaaggggaaaagaggagcagggaagaaatggataatactatttctagtacccttccttcacagagaggaatgaattaaacatgaggcaagaaggtcaccaagttagttaggcatatgaattaaatcagattgtctgaagaaagtactctatgaagatagggcacagagaaagaatacaacaaaaatcagatgataaaaaatgaaaaaaaaagttgcatttgtatggcacattttaatatgttaagtactaataataactcttgccattatgtgttaataatagatccttttctgtatcagctatattgtatgcattatatataaatgttgacaacatgaaagataattcctgtatttctattctacagataactaaacctaagctcatggtgttaaatatccatagacacccatctattcagtggccagcagggcctgaagccatatgatagccaccattgcacacattttgccaccatgtcacctgttatcatttgcccttcacaacaactttaaaaggcagaaataagaggtgggatttccatttgcctgatgaaaaaactgagtttcttaaaatttagtacttgcccaaagacaaagtgaattaattaaatactggtctcttgacatctgtgtctaatgttcttgtcataacatgatgttcttgtcataacatgatgctcttggtgttggtaataaaactaatgtttctcaaatagaggatgaatttgtgagttagtaaatcagttcagttttgacactgcaatctccaaagagatcctaaaattattttcatattttcaaacgatgtggattaatactcagtatcagattgcattctacaaatagtattgccttgagatccatccacttgaattaaccaaaaaatactactaattaactagacttgagaaagggctggtactaggcaatgtgacttttttatgtcatatgtcacctggattacattttcactctgatgtacatgtcattgacagcagtaggctgctagaatttgacaccatgaatttatctgatgaagtgcacagaaagagatctgtttattaattcgtaagcacaatctagagccattttataatacagtatttcccccttcacagaatgaatcagtacttgactgatttaagtataaaatgccttggtttgttaaacacaaccccatattggggagaattggacttgggttctactagcagttgtcccaaaatttgctattcttaaacaagttgtcttccctctcaggacttcaaagtcaccatcaaaaacttagaaacatctcaagttaacaacctaatatcacaactaaaacaactagagaaccaagagcaaacaaatctcaaagctagcagaaaacaagaaataaccaagatcagagctgaactgaaagagatagaaacacacacaaaaaaaaaaattcaaaaaatcaacacatccaggagctattctttttttaataaaaataaataatatagatcactagctaaactaataaggaagaaaagagagaagattcaaataaacacaatcagaaacaacaagggggatatcaccacggaccccacagatatacaaacaaccatcagagaatattataaacacctccagtgttttctattttatgcatacaaactagaaaatctagaagaaatggataaattcctggacacatacaccctcccaaggctaaaccaggaagaaattgaatccctgagcagaccaataactaccttgaaattgggtcagtaataaatagcctactaaccaaaaaaagcccaggaccagtcaaattcacagccgaattctaccagatgtacaaagaaaagctagcaacatttctactgaaacaattccaaaaaattgaggagggactccgcactaacacattctataaggccggcatcatcctgataccaaaacctggcagagatacaacaaaaaaaagaaaacttcaggccaatatccctgatgaacatcgatgcaaaaatcctcaataaaatactggcaaaccaaaaccagcagcacatcaaaagcttatccatcaagatcaagtagtcttcatcctcaggatgcaagattggttcaacatatgcagattaataaatttgattcatcacttaaacagaactgaagacaaaaaccacatgattatctcaatcaatgcagaaaaggccttcgataaaattcgacatcagttcatgttagaaactctcaataaactaattattgaaggaacatacctcaaaataatgagtcatatatgataaacccacagcaaacatcatactgaatgagcaaaagctggaagcattccccttgaaaactggcacaagacaaggatgtcctctctcaccactcctattcaaaatagtactggaagttctggccagggcaattaggcaagagaaagaaataaagagcatccaaataggaagagaagaaagcaaactatccttgtttgtagaggacatgatcctatgtcttgaaaaccccatagtctcagcccaaaagcttcttaagctgataaacaacttcagcaaagtcttgggatacaaaatcaatgtgcaaaaatcactagcattcctatacaccaacaacagagaagctgaaagccaaatcacaaatgaactcccatccataattgccacaaaaataataaaatacctaggaatacagctaattatgggggtgaaagatttttttatccaaaactaaaacaactgctcaaagaaatcagagatgacacaaacaaatggaaaaacattccatgcttatggaagaaagaatcaatattgttaatatggccatactgcccagagcaatttatagattcaatgctattcctataaactaccattgaaattcttcacagaactagggaaaactaggccaggcgtggtggctcacgcctgtaatcccaacactttgggaggcagagatgggcggatcacagggtcatgagctcgagaccagcttggtcaatatgaagaaaccccgtctctactaaaaatacaaaaattagccaggcatggtggcatgcacctgtagacccagctactccggaggctgaggcagaagaatcgcttgaactcgggaggcggaggttgtagcgagccgagatcatgacactgccctccagcctgggtgacagagtgagactccatctcaaaaaaaaaaaaaaaaaaaaaaaaaaaagaactagggaaaattatttttaaatgtacatggaaccaaaaaagagatcgaatagccaagacaatcctaagcaaaaagaataaagctggaggtatcatgctatccaacttcaaactatactacaggcctatagtaatcaaaacagcatagtactggtacgagaacaagacacagaccaatgaaacagaagagagaacccagaaataagaccacacacctacaactatctgatatttgataaacctgacaaaaacaaacaatgcagaagggattccctattcaataaatggttctgggagaactggctagcaacaggcagaagattaaaactggaccccttccttcaccatatacgaaaattaactcaagatggactaaagacttaaatgtgaaacccacaactgtaaaaaccctggaagaaaacctaggcaataccattcaggacacaggcatgagcaaagatttcatgacaaagacaccaaaagcaattgcaacaaaagcaaaaattgacaaatggggtataattaaataaatagcttctgcacagaaacagaaaataccaacagagtaaacagtcaacctacagaatgggagaaagtttttgcaaactatacttctgacaaaggtctaatatccagcatctataagaaacttacatttacaagaaaaaaaatcccattaaaaaatggacaaaggacatgaacagacacttttcaaaagaagacatacatgcagccaacaaccatatgaaaaaaagatcaccatcactgatcattagagaaatgcaaatcaaaaccacaatgagataccatctaacaccagtcagaatggctattactaaaaagtcaaaaaataacagaagctggcaaagttgtggagaaaaaaggaatgcttatatattgttggtgggagtgtaaatcagtccagccattgtggaagacagtgtggtattcctcaaagacctaaagacagaaataccatttgacccagcaatctcattactgggtatatacccaaaggaatataaatcattctattataaagacacatgcatgaatatatttgttgcagcactattcacagtagcaaagacatagaatcaacctaaatgcccattaattatagcttggttaaagaaaatgtggtacatatataccatggaatactatgtagccacaaaaaagaatgagatcatgtgctttgcaaggacattgatgaagctgaaggccattatccttagcaaactaacatgagaaaagaaaaccaaatactgcatgttctcacttataagtggaagctaaatgaggggaacacacagacacgtagacaggaacaacagacattggggccttttgatgggtagagggtagaagaattaagaggatcaggaaaaataaccaatgagtactaggcttaatacctgggtgacaaaataatctgtacaacaaacccccatgacataagtttacctatgtaaaaaacctgcacttgtacccctgagcttaaaagttttaaaaaagtgggattcgattaagtaaattatcattgatgtgcctttcagcattcaccaccaaaagtattttatcacctagagatcaccaagctactacccaatctaatggcaaacgctggctcttttcatttcttacgaaccctccatctccaacatactaaacaaggaaacttgtctctccagtcaaacctccttcttttccacattcactctagtcttcagttgttcagccctttctgggcttcctcccatttcatacctaacagcaactcctttcttcatcattcacttaatgctcaaataagtattctcactcctcccaatctctcaaccttcattcttctcccatgttcacattgaaaatccccagttcttggcaaagctatgtatccactgccatcacttttgcttctggaaagtttaagaattctgtagaaaatcacataattcacacacacacacacacacacacacacaccactgagttctgtgtcatttggtgctatcacaaatgctttatttccaaccttaattgagccttcagtactaatcaactcatcttccattcatctctagttaaaattcttttctgttcaaagtttgacctcttgctattcttctacctccatgacttagtcactgatttctcaaacaaatctgaggacacttttaccaaaaccttttaaaaatattcactcttccttacctccctccgacatggttattcttccttttccctaggtatagtttctacacaagtgaccttgtcccagtctactcctccttgaacatcacaagttagtctcgtccatttttttcccatttcttagatgttcaaaattcttcccatcaactgacagatgcataagttttctatataataaacatcacctatcttttttttccacttactgtcaaactctttgaaaagctaagttttcttatggttttgttttatattagtatttattgtttaatttttctcatgtttttgataaatctcaatccactgacatctagattttgccccaatcactctgtcaacactattctcagtaatgttattagaggcctttattttctgatttaatcattttgacttaattataacattttttgctgttcttgaaatgttctttggatttaactcttagggcatcactatctccttatttctctcttatctttgtttctcctcaactgtggtatgtattgttgttttttgctgttttggtggctttccttgacctgatcatttatgaagtggtattcttcagggttcagttatttgtcaacacatatgtcccctgcacaagtgcacattcatacacacacatagaaagggagagagagattcatgtactaataggccccaaaatcatcatctgtcctgaataacagaactgtattctcagccacttttctctatgaaggcatttcacacatggctcaaacataacactttcccattggccctccatgcctccatgtgaaccatatacttactatctactacttaacaattatttgacttaagagacccagaaaacaaatggcttatgtatgccttattatacaggcacgtttatacaaaaagatttctttagaacaacttctaacatttacctagaactgaccatgtgcctgggaccttgtgaagtggtttacaaagattgtagcaaatctaatcattacaataaacctaaatagtccatgttatttttatctctatcaagatgtagagatagactaaagagaagttcagaaatttgctgaacaaataagtgatggagacagaaaacccatccagcccagctggttcagcggatgagattgcctccagaagacaatatgggcagcttcattaaaaacatgggatggcagtggtatagccattacctcctttgctcattgaaaacaataacaacaataataataccagatgacatgtactgagtgactgagtgcttacaatgagacaactgctgttttaagtgctttataagcattaattcatttaatctccacaataaaaaggtattactattactcccattttacagatgagggaaatgaggcatatagggcttaagcatctttttcacttttaagtagcttgcagaaagtgaacccaggcaatctgattcaaaccccctgtccttgacctctacattatattattttactatataaacaattagttaagtttcttaaagtagcattgagtgctgagtcctaggtaccccattcccgcctctcttaccacctcaccaccaccaccatgccacctggcttcatcttaataattaatattcttgctgttatgatgcttttttttaaattttctccctcctacctgctttcagcttgttagtttttaacaatgcctgcaaatgttttctttctcagttccaaaaaaattctactacattctggtctcatcctggataatctaattttactgatctttttcacaagccacacctccaccacaccagcaaaaaaatgaaccacttaaaaccactaccactcttccatatggatttctttttttaattaattcattaaatttatttatttacttattttgagatagagtctttctctgttgcctaggctggaatgcagtggcgtgatctcggctcactgcaacctctccctccctggttcaagcaattctcctgcctcagcctcccaagtagctcagattacaggtgcccgccaccacaaccagccttttttttttttttttttttttttttggttgagaccaggtttcaccatgtcggccaggctggttttgaactcctgacctcaagtgatccacctgcctcagcctcccaaagtgctagaattacaggcatgagccactgcacccaaccttccatatagatttgtaagtcgtgagtaaccacaaaattttactgttcaaatcaagagttggtgctattacaattatgttgggactgtgtgtataaacagactgtgctgagtaaactgagtggtacagtcacatcacttctgacccacagaagacaacacagctgtactgccacattgtcactgcagagatttccttgctaacagatttcccactgacaatgatattatggtttcttccaatggcactgactataaaaaaaattggaaattctgctgggatctatgaataacaacaagcacaaagaaaacaatgttgccaaaattttaaaacaaaaattgaagaataaaggaataagatttaaggttttaagtctattataaccaatggcaagtagacaaagctgaataaaaatggacttaaaagtatttaataatatttctttaaatcagcaggatttaaagaacagagaccttacttcttaaagtcttttcaataaaatccacagtataatctcattgaaaacactcatcttgttaaataaacattatctaatgaacaaaggattttctcaaaatcctttcatatcttgttattctcaagtataaattgaagctttcaacttgtctttataatgtaacctcaatctcaaccctctaacccttctccatagcacttaatactgttattcctgaaacataaatattgctttgccagagaagaagaagaaaaatgaagaggagtaggaggagaagaggaagaagaggaggaagaagaagaggaaggagaggaggaagaagaagaaatctttaagtccatagtttattaaattggtaggaatcaggacataatttgtatctatgtaacatattcctaggattcatttctatagttattcagcttgaagcagtgttgtgtttacctgacactcaaaaactgatactcttgacactcagagaaagttattttataggttatgaaaatgatgactgatggctgccttatatccttggtttaaaataataacaacatggatatatgtgaatatctctgaaaaatatattaacaataaatttctacgttttgtagaggctaaaaggtagaaaaaattctttatgtaacagggattctaaatgaaatttttaattccctctcttcccccctttactatcttgtgtctgttgtacatttgaatacgaagagcagaagaaaaatggcacaagcccaaagtgaaattttgaggtaagaaaagtttgcgttgatggtccttttgcttcttgaaaaataacctgttccacactggggctcccaaaactacatctatttcttcagaagaaagaatctgtcatctttatttgaattgtaataaaaacttcttctaagaagctagcactcagtttgcatttacaaatatgaacatttaaaaaatctctagttgtggactgaaaggaattaaagcaccaagtttcaagcagtgctgtggtttttagaaaagtctcttctcattgtttgcaaacctgtagcacttggaaggctactctgcagccagttctgctttaaagatttggaagtgatgggcagacacaaagtcagcagagaatggtagctgatctttaatcatagatacatcagtgatccctggaaagaagaaaatggggctgaagcttccagaaggttagttctcagaagcagtagagcaaggttcacgagagccatcatgaatatcacccaactaagcaaaaatctgtccaaatgtctagaaagtggctatcttaagtctcaaaccaaggactgagaaactcaaccccttctgtgcaacctcccctgatccattatgtaatcatctcctgctccagaactcttaccctactgttttctatctcattataaagagtttattttcagaacagaaagagacaaagcaaatggatatcctgctctaaaatccatgaagtttaataggatcaacagctaaggatgggatgagcaagccaggttagaggtggaacacaggggaatgtggccctagagaactgtgcgtgggatagagccccagctgatgggatatgaggtccagaaactacgtgtgtcattgatagtgggagatggaaaaaataaaccaaactgacgaccaatccttgaaaattaactgtaaaagagaagagaggaaaacagtatttagtctcacaggtttaaaaggatactcataattgggcctggtgtggtggctcatgcctggaatcccagcactttgggaggttgaggtgagcagatcacttgagggcaagagtttgaaaccagcctggccaacatggtgaaaccccatctctactaaaaatagaaaaattacccaggcatggtgacacgcacctgatgtcccagctactcaggaggctgaggcaggagagtcgctgaggcagaggttgcagtgacgtgagatcgtaccactgcactccagcctgggcaacagagtgagactccgtctcaaataaataaataaataaataaataaatataaaggatactagtaattgtcctcttaatgagtgctttggatgtgtgcctaaccaaacacgctgtgaggtaattgtagtgcatgtcatgaaatttgtgttagattagcatttatttgcaattactttgattacaataattgcaatcaaatctgattggagaggtctcttgtgaaaatcccatcaacacatattctgcacctaccatgttcaaagtattatgctcaatgctgaaaacacattctcctcacttcagaatgggggctgtcaaccttggcacttttgagatattgaagtggaaaattgtatgaggctgttctgtacatcataggatatttagcagcctccctggcctccatccactaaacgcccataagtacacccccgtgtccccagttgtggcaactgaaaatatctgcagacattgccaaatgtccccgaagggcaaaatcatcctggttgagaagtcagtgctacagagggattcttcacataccctgttcttaggtttcttactgctcttgcagcatggctgacttcttatcattttaacacctcagccagaactctgactataaacaacaacagcaaacattcttattgagtaggatgcccaaatttcaattcctgggcatttgcaatatggcttgtctcctacctggcatttactttttttaaatcctcattaagaagttgtaaacactaaatacattgctgttggcactaaaacaatgcttatacattcaacaaatacctaggagataggaagtaaggaaaggatcacattatattagccaattaaatcatccctttcttaacgaatcaagtcatctgttagaaagtaaatggtacaaagtaactgtgttaagagttatcaatgatcaattatttggaaataattcactcagagaccactaaacaggtctgaacagccatattacaaacaggaagaggctgatttgcttttcttataaaatgttgaggttctagaggtataaaacccattagactagacagaataattgtattcccattcgtacagactcattgcagagtagaaaatcaaatccttgggaatcagatgaagtatatcatagcattcttaattatttgggatctaaccagaatcattaaaatggtaaaaacaaaattatattttaaaagtacaaaaagaatttagttatgattatcatcagcatgggtttctcatctacacttcaacaatgagattaacactacatgaaacactggtctaatgctttacaagaaagagttaaacgtccctcaaaagcttcagataattacctaagccagaagcaagatgttagactaggcagactaatgatctgatctaggatggtaattcccatggttcctaaggagcacaagcatcaatcatttaataaatacatggtttccagtggactccagagtgggtgaaaaaaaatctcagcagtaagaaaatagtccaaattttcctggtgtatcaatatgtatgtcgcttaaagcaagtctatttctaacataacacatttctaatctttctttcatatgctattatattaattaatgcaagaatcagtgccagagggggaagtccccataaatggacaataaagtgatgggttttaacaagatctcgcaactctgcgttttgaataattataggcaaatatcctttttgatcataactacttcatttctttttaaaaaattatactgtagctgacttttctacctttccacctctcagataactatatcatggctttcaaaacccatggtctccagttatgaaacacctaagaagattccacttgactctaagtaagcctcagttggttaaacaattatccaaatctgagagatttttaatttcatttctgaattctcatatggtaatttttttcttttgttgtaaagttctatgaagttcaacaaatgtatacagattcatataactactaccataatcaggacaaaaaacaattctctcatctcccaaaagtcccttgggctaccccttacagtaataccctcaccacacccatatctctggccaccactggtctttttactgtctctatagtttttccttttccagaacgctacgcagttgcaatcatacaggatgtgtagcctttcatactggcttctctcactctgcatgtctgagaatcatccaagttgttgcatgtatcaatagtttgtccctttttacttctcaacactagtccacagtgtacttatccacactcttgatgaaggatatctgggttgtttccagtttttgactgtcacaaatgaagctactatgaatgttcattcttctaaaaatttttgttgaatataactttttatttctctaaggtaaacaacctggaccagggctgccagggcgtatgttaagtatatatataactttataagtaactgccaaactgttttccatagtgtatgtatacttttgcactcctaccagtaaaattctctaaaattgggttatataatgtgacagaggaagctgtaatggtcataaatgatttgtttatttctttttgtatctgtgctaactataaaatgtgctccatgctttttgggctattacgaagatcagaaccacactcattaattcaacaaatatttggcgagaactattatgctgggaatagtattaaatagaacaaatttggcctctggaatatatatatggagtgtgtgtgtgtgtgtgtgtgtgtgtgtgtgtgtgtaaaaacagtaatttattattacctgagtaatttttcattctaaggatgtatatagagtatattagctaaagatattttaggagaacttggccttgttttgatcaattctaggtacatctcataggaagcataaataaaaaacattaactatgctataattctgatttaataacaatgaaattaccaagtgttcctgagaaattggtacaaattagaaactaattaaaatataatacaaattttaataactgaacaagaaactttgattccaagatctagaaaaagcaaatttagaatgcagacagaatgagaactatgaaaggtactttaaaatatcaaaattcttttgataaatggagagagtatttgaatgtcatcaatggctaacactcaattcccctctctggctacacaacctcaccaagctcaatctcctccccaccttctttctctgaaagttcaccctcttgtccagattcccagtattccatctccttattaaggctcattctaggattttcattctctaattcctctggattgatgggtcactgcctcaagatcatacctgcagcttccaagtggaagacaatagcaccccccaaggattgaatctctccccagctcagactactagtttactgcaccccagcccctcatttgggtcatccagaagaggaatctgagattaatatctaacttgtgattcgccaaggaagggaaaataagccaaaaccattctgtatgcacttaacattgctttctttggtaaaatgcagcccattacctgaaaagcctctgaaatttgcagagaattaaaaaaccccatgcttatataaaaggctgagtcattttctaagagttaggcaagcaactcaaagagttcaactgctaacaagattgttcagaaatgaagtcgcctgaacataatcagtccaccctaattgattgcatacagttttattacataactgatggttctaaaccccagccaattagtttgtcaaacaaagattaaattcttgactggtttattcaagttaaatttaggaaggattcacaatagaacccaccttatcctggcagctgaaaatgtactctttaacaactaaaattattatgggactttcctataaccaaaaacagaaaaagagaaaagtttcattgagatataaattttgaataactaaaacattaactctgggttgtattttatctaatgcaatttcctttgctatatagtttcctaattttgagatctttttaaaaaaattttcatggtgagtatcactggtaatgccatattcgaaattattaaactagaattaagcaaaaaattagcctatttggcctgacattgattccaaagaatctcttaggctgcttgagtcattattgccagtcaatcattcacagatgtcaccaacttctaatgtttggtaaagagttaagtctgtccaaagattctgacatttatttctgagcatattcctcatagtagagccaagtcatttaaaataatcctcattataaatgctcatgtttacattgcatttttagcattccattagttaaattccagtatgataaagcaaaatattttcctaaaactgggcagctagagaaataaatcaattaaccagttttcattaagcacctgttattcattcagccctatgcaaagtaaaacaagatacaaaagaaggattagaaatagatataggtgagacacagaattcatgatttcaatgtccaggctagtgttaaatattgcattggaaagatttttagaaactaattttttctccaactttatataagtttatattagtattttatagtgcagaagtcagcaaaatttccataagagaccaaagagtaagaattttaggctttgtggccaagaggaaaaatcaaggatattatgtacacacttattaaaagagaaaattaatttccacatttttattgataaaattcaaaaattatatcatattaatcatatctcaaacaataaaatttgtggaagtaattactatgttttattttataagacctcaatacagaatagagaagtcattatacaagaaaactacttgcacacacatgtttatagcagcacaattcacaattgcaaaaatatggaaccagcccaaatgcccatcaatcgaatggataaaaatacatattattatatattatatatattatatgtataatatataatatattatatatattatacgtataatatataatatattatatatatgtcatggaatactactcagccatacaaaggaataaattagtggcatttgcagtaacctggatggaattggagactattattttaagtgaagtaactcaggaatggaaagccaaacattgtatgatctcactcataagtgggagctaagctatgaggatgcaaaggcgtaagaattaaacagtgtattttggcgactcaggggaaaagataggaggcaggtgaaagataaaagactacaaattgggttcagtgtacactgctcgggtgatgggtgcaccaaaatctcacaaatcacctctaaaggacttactcatgtaaccaaataccaactgttcctccaaataatgaaattaccaagtgtttctgagaaattggtacaaattagaaactaattaaaatataatacaaattttaataactgaacaagaaactttgattccaagatctagaaaaagcaaatttagaatgcagacagaatgagaactatgaaaggtactttaaaatatcaaaattcttttgataaatggagagagtatttgaatgtcatcaaataagaaattaaataataaattaataaatgcactgttaaaagagaaagaaaaaggaatagataattcaaatgtaccaaattttttctgggattcagaattatcagaaatcaatttttttttttttttttgcttgcggttaccttcaattaaataggtgttaagctttcctgtagtttgttctagataacaaggaaacaaagataaatggccccctgccctcaaagcactaaaatgtaagaggaaaagacaaatagacaaagcacaatgatggcatgtaatgtgtgctgcaataaatgtctgtatacagagtgctccataaacatttatagaaagtgctacataaacaaagatgaaggacttatgaaaatattgttgaaggtttatctaaaaaggtacatttctccccttgtggtcttagtaataaaaacgctgggccttcagagtgtctaattgattgaggatccttttgttgcttctgaatgatggttctgatctgttttcattatatattaatagctttatagtggtgggtgttccagtaatttgcttgaatcagaagggactgtgaggatacagtcaagaagtactttatttctatattttttttactaagtctatcacagtgcattttcttttctcctggcaattatgattctggttatttgagggctctagttaatggagaacttccccctagcagtctcaagcactaaaatgaggattgacaaaaaacaaacaaacaaaatccagattattcaatataattccaagccagaagaaggaggggaataactataattttattatctttttttaaaccagtgtgccatacagtaggcaatgaactaccaaagccacatacttattatctaaattcagaaggaaaccaaagtctcaagtctcctctctcccaaggaggtctgttgtaaactatgacctaaaatgtagcaacatgcctgattgatgacatattaaagaatcttgcaaacttttctcttcaaatatcaactacatgatgacttcagcatctccctgtactacaccaaaaggatgcagatggtacacattttgtgttttaattcctggaaagctcatctggaaataaacataaatataagtcaagatgctctactgttttggagggaatgcagaccattcacatttctgctccagtgatcctcatttgaagggtagctagtttatttccaaaagtctgttgctacctcagagtcacatcagccatgccaatactgacaggaggcactaatgagatcagaatagctacatcttctatctttctttatcctccctctgacaattttagtcaaccaacacctgtagaaagggagtttactctgcaatctcttctggcatgcaatctattttctagattggtaaataaagcatagacacccatcaaacgaaagacaaaaccagaataacatattgcccagaggtacagaggcctcaagcaacaagcagtgtttatcatactgcaaaggagagtggtacctgaaaaggagaccagagtcttgtgatagaggttagattacaaagcacatcaaatgttataccaatgaactgagattttcttctataagataaagggaagccagtacaagttttatacagacacttacataatcagattaacattttagaaaagagcacttctttctgtagactgtggaattatagacatttagactagtaaaagaagaacagtatttactgctatagctcaggtaaaagctcacaccaaagcagtagcaagaaaattaagaagaaaggatggatttagcagctattaagaagaagaactttgcaagtctttgtgactctgtgaaggatggaaccgagggaggtgcagtcaagggtgactactaatttgggagactgggtggagagtgtactgttgaaaataaggcattctaaaacaggtggaacagagatgttgtctaggtaaaatagttggatattcagatctggaggtagtggatgaagggtaagactaggttagagatagggatttgggatcttcatcacagacctgatagttgaaggcctgggctttgataagatcaggaggagaaaaattaagaggaaaaggagaaggcagttaaagacaaactttagagaatactaacattggaggtataggtagaagaggattcagagggagaatatgaagaggaggcaatgtctgaggtagtggtggctcccaaactcctatttcaaaaggactgagatcagcaatgaggtcagaagagggcttgaagatttgtttgcatagtagagtatttaatcaaataattgagaaaactcagttgtccatatcaaagaatgagggctgttgtggacattatgttcccaacccagctccacctttcagttactacagtaccgagaagtagaagaaccaggagagtgcactgccttgaaaaatcaaaggaggatgggattttaagaaccagggagtggacttggtgtcaaattccccagagatcataaagtaaggacaaaataccagtcaatttagcaatgactaatgtttgccagtgcaatttcagtgaagtgatgaggggaaaagcccatggcagtgaggagagggtgagtaagaggtaaggaagagtcaatgtgggcagacctctttaagaaatttgactatgaagcaatgaagaagaatatgacagtagctccagggggattctgggtcaaagagcctcaaaaatagtttgactgcacaagtagagaccctgtattagagctactcctcagaactccacgatacacctgcaatgccagcagcacagattgatgactgttcctctctggaaaatgtctctcccatagggccccatttccatctaaaagtccactaagattcatttagttggaccttaaaggctttttactgacagcaattttctattaaagtgcaaacatccagtaacaactggaaatgaggctaggatagatgcttgaagtagaaaggggaagtgataaagcaaaagccaaaaaataaaaattaaaaaaaatctttgcctgcttcatggtcatgggcagagaagggcaattgtgattaatcacaggtgctggctagctgaagttattctttatgtcttatatacagacaggcattatacacagagtatcaatttttagaatacaaattcaattaaataaacttaatactaatttggatgaaaattaagtctattcggtgatacagatagcatttacagatattaaatgccccagggtaaaacttatggagatcatttgtaattttccctaaatgtataatcatagaagtaaaggaaggacttgggaaaatcaaagcctgataatgattactaggtgactttcctctctcgaaattttttcacaattgaaacagctcattgataccgttgcctgttgtgtctgctgctgtctccatcccaatttctttcttctgatcataggtccacaggaacagtgttgttgacttacatattgaatgcagtcattcacaatttatgcatctgcaatctacatatggccctttatgcatgtaagaaactgaaaataatgcttccaacctgtctaagagatactgcagcccaagtaggcccttcctttctgctacaaattgaaaatcctttccccaccctgtcaaggataactttatatatatatcatctctaattctcccatggtaaaaaaaaaaaaagggtaacatgactaatgaaagagggaggtgaaagagggaaaggaggagcagcagaaggaggaggaacaagtggaagaggggtcagtaaatgccaaaactattttccatccattgaatcactgatactccacttccatccctaaactctgtcccattttgtcatctgtccattaacaccttttccctacagtcccatcccaagccaaattcttgtaatgaaatgtctagaaaagtgtgaatctgattctcctctgaaatattttgaattttactttaattctctggaaagccgacgaagtaccattagcttttatatgtgaggttgcctttctctaaagttgagctcagaccctggctctgatgatctgagatgtggcagtgttgctataagttgaactctcaaaattattgcaaaggatttgagaattcatatgctagccaagcattgtgtaaactggaaaaatattaatttgatgaatagatttctacactttttctttcaaatttgattatctgtgtggtgattactaaaacatgttcacttaaaagaattgctgaatatataagaattgctttatatcaatgtgtatatttataataatcaataaataagaaatcattgctaccatgacagcctgataagtttgttgacattaagtatgctggggagtgatttccaaattaaaaatgtgacactgtcccaagaaagaatgttgaactaaaaatggtatctgaaaataaatccatcagcatcttcactcatcctttctgctttcttttgcctcatttgatgttcctattcctgcaaaaggccctctagcctacagggtgactttttgcaactgtgaacaaggcacctccagtatgatgcatcccataccaggtgaacagagtacaggctggcctcattggcaaactcaatttcttccacctgtgctctgaaacccacatcctcccaatttatcaagaaatcttgctcccgtacttttactctaagtctactgacttatcctcatgaatattaaaacatgtctaagacctcctggatcttaacagatcctttccccaactccagctaccactctgtcctttttcctccaacctttcatacttgctagacttcttggtaaaatgttttactctcaccatccctacgtactcccacttacccccaacccattcccgtctgacttccagccatgccacttctctgaaactgcttgtatcaagattatcaataaagtctatattatcagatccaataatttcttctcaggactcattttttccctagttgaaggatttgatactgtatcatcccacccaccttggaatgcttttattctgtgaatttggtgactctaaaattaccctgtattcctcctatatgtctgtctactccttctcaatatgctttgtgagatcgtccttgtctagtcattccttcaacattggggggctcttattctgcacacataattttattctgtccctgagccttggttacatctacagggtgatcctcaaatctttgacctgtcatgtaaacttcagaactgcatatttaattccttaaagggcatcaccacttggatgactatcatatacctcatattcaatatgtctaaaactgaattcttcaaatctgcttctcctgcaggattctcccagtacatggcaccaccagccactcagttgtttaaggagcaacctcaaagtcatccctccctcctcctctcttttcctcatctcttacctctaatcaatcaagaagtccagctaatttcacttcacaaatctcactggaatccatgtatttctcatgtaatcatcctcatcatttgctgcctcattatctcctatgtcattattctgtactgaacttgctgatttatctcttgtccctatccaatctattctctgcaacacagtcagaatactcttttaaacatgcaggtctaatcatgatatttcctcatttaaaatcctttatgaatgtgttactgcccttagaatcaagtcccaactccttaacatgggttattatatattctgggaactgagatttcatgttccaatatcatcttggtccattctccagccaggttggacttcttttcatttgttaaagatacaacacagtctctaatctatgggcttttgcacagattgtcccaccatctcatgtactttttccaacaactctttctatacaatgataacttgtctttcaaatctcaacctccatatcacttgctccaagaagatttcccttctctcctaaatcaaatattgacaaactatgacccatagggccaatttgcccatggcttgttatgaaacagccctcaggctaagaatggttttaaacttctaaaaggatattaaaagaaaaagaagaaaaagagaaaaagaacaggaggagaaagggaagaaagagcaggagaaggagaaatgaagaccatttatggcccttctagcccaaaacagttgcctttaaaaactaaaatatttactatctgacccttttcagaaaagtttgctaactcctgccttagatcataagcataggtccccctactacgtgctcccttgatgccctgaactttcctggttatcacatttgtgctttgtattacaatcagttttttaatgtctcattttcacactagactatgagctcttcaaagtcaagcaccatgttcacctttatcacactacattccaagtatgttgtacctggtagagtctcagtaaacatttgttgaatgaaccaaaatgaaaatgaaaacaaatgacagcttccatattgctggtgtccacaaaaaggccatggaaacacttccaggggtgtatgactaggacaaccacacatccccatgtttttcagggcagtgatgatttattcttgttgtcccagcaaaattattaactgttttccctttccctctcaagagtatctcacttcggaggaagttaggatactcggaaaaagttcttaagcccaacccctgggaagattttctagagaccattgttgcagaaatgatagtgatctttgtatcaaaagacagcactctttctatgggaaaaagaatcattgtaacacatactgttcagaatccagaaaaatattagtaaaatgtgtttatggaatattatgattgaaatagacttttgttcactgacgtaaaggttttcctatgatttttaacatggtcattgtgtgaaatacattgcaaataaccaacttttataaatccatcttgagtttggaacagtcaatataattacatttaatgaataaatacacagtaagtttttttgtgtgtacctgacatctatgctttagtcattttttttttttttttacataactgacaaaacagatattctagctagtcaatgtgcaggactgatttaaaaggaattggctgggcacggtggctcatgcctgtaatcccagcactttgggaggccgaggagggcggatcacctgaagtcgggagatcaagaccatcctagccaacatggtgaaaccccatctgtactaaaaatacaaaaaattagccgggcatggtggcggctgcctgtaatcccagctactcgggaagctgaggcgggagaattgcttgaccccgggaggcagaggttcccgtgagccaagatggcaccactgcactccagcctgagcgacagagcaagactccatctcaaccaaaaaaaaattattttcagatatagaattgaattaaagttcagtttgggaatcttctggctcaacattcctattttatggatataaatatggatgacaagagaggcaaatattcctgcagtggataaggctcctttgaaatcatcaatagtcctggttgaacatttttccataaatgtaaataaaattaaacataaaatatcatatttatattgcattcctttttttaatgactttgaaatcactttggaatcttcacgtctcagattcacctaacagaaatctatattgtacttatttatacatgaatcttagctatccaatggaagatatgagttctacatcttttaatttccttttcacttctctaaatagtgttttgccaccactgttctgggacccaggccaaactcattaaacatatatatctattactaataatatattatttgaatatgtgttgaatatacactcaatactcaatataaaatttgaatacttattgaatatatgcaacatattaggcagtaatcttatgtaatgtttttactcatcacaaaaaccaaatgaggtaagcgccatctataaaaatgagaagactgaggctaggagcaaataacttgcctagagatacacagctagtatgtgcaacagatgggatctcaattcagatctttctgagttgactatgaacaacaatactatcataaccatttccttaggaggctgtatcaggtacctcttgtgtgctacttcaaatcttcttggtctcatcttttactttagccactgatgaggctcccagttccatgcaggaggaagctaacagtgtcctgccttctgccccaggcctctctgatgttactgcatgagatgaaccacttagcattcatacgtgtgcaaccaagaagtgttggtgttggggatactttaaccaatcagagacaggaacctgtcccttctcctttttcccatgggcagtgttgggataaatttcataaggatcctgagaaagcctcacaagatcagtatttcctgtaggcatcctgagttgccttccctccttctttgtttcactaatgcagtcccccactcctgttccctggaaccatctcccaaataaataacctatacgcaagtctttgtcccaggctctgttttcagtggcattcaggacaagaagaagccatttccctcaccagctgaaatcatcttgtctctatccctgagctttatggaactaatatgcagcagctaatatattttatctgaagaggaaatcccctgtctccgatggacctgacttcttcatttcctgtgaatagcagagctatctgcatctgtagggtctcaggaccatgttgagaatatttgtctacctctgctggaagcccttctgattagtcaggctccttgagttggaaacataaggatttataatgaaaaagagtcacacagtaaaaacagaaagaatgaaaagaaaacaaaccaataaagaacctatcctatcataacatttgaggttctggtatttgctggctttggagggagttcaaaataaatgaaagaaatgtgtattttattaaatgctaatatttagaagatgtggtggaaaaaagaaagataaatgtttccaatcatatttgcaaatatgaggcatctcctacccctttcacaatggttaggtattttccttgcatttgagcaacctacatggttttggaagtaatgcctggaactagccaaaaaaattgtactaggagtagcatgtgaatctaaccaacagagattgcaccacattatgctctcagcctagatcacagtaaaataataagctttatctagtcgagttgtagctgccacccaacttcctccacagaaagggcctattgcttctgactccacatagaccagtctataataaactctatcctttccttgcaacatctgctgtcgttaacatgatctctgtttgtcttgaagtataaataggccccaaatttcaaaagttcagaacacactgaaccgtaaccacatagcttcttccttttcttcttggtaagagccttatccctctcttgggttttggaattcattttaaaaacaacaatgaaataaagtggagaggaagaagatttggagggtcagaagtactcaagggggtcagaaatgaagacttccctttgtttttgtttttagtatttttgtaataatacaggttgaccatgaatttaaaccatttcttgtatacccttttatccatactaaagtgaggagtttatcatcaatataagtcaaaagaagaaactaattttaatattgattatttttattcagtactcaaagtggtttacaaggttcagatataccatttgttttattttgcttgaacaaaacatttgtaattaatgcacttctttcaaaaagagaaaacaggtgattcttatctttcctctgatgtagggtattgataaagggcaaagcactgaggcctgacagccctgtattaccagcctagccctgcgatcaagcaaattgacttcacatctctgaaattcaacttactcctctaaaacgtggatgaaatcagtaatattttcatagtactgttaaagtagtagatgcaataatgcatgtgaaatgtttgatatgtgtgtttaataaataatagataatgattttccaaaggcataattggatcttccaatgtgactgacaaagctttatgatccagttatctaactaaatcagatatagacggaaatcagtttcatatgtatctccagctgagaggttaaaacagataaaatgattagaagagtatctagcaggttgtaaacacttgataaatgttagctattcatcactatcattattaatatatcattaataatgtataattattcatattattgtaatcagtttactgaatggcctgggctcagcaggtgcaagagaggaaatttagtctttctaaccaattcgtatttaactcatactgtcaaatgatttttcttagatcctggataaaactctaagcagatgacataacttttttgaatactttcaaatatgaaaaattccagtgcaatctaatgcaatctcaaatccttttgaaaatttcttccttccctcagcccaagcctgcctcaggctggaaaatctgtgatggggaaaaaaagtttggttggctttggatcattttccttgactcctcctcctctactcactatgaagcctctggttctccagggttgagcatagggcctggagttgagagagggaagggcaatgtaagacagaaaagatctgccgtgagtaagaacattgataatctagctttgatttttgcagatttatatctagctttgattttttgtgagttttgcagatatctgaaactgactccttttggagtcaggcccttctgcaggttctgcagagatttacactcaagatatgcagctgcttgcctggcatggacaatacctgttccttctggctatttaagatttctctggtagactctagtgtccaagttcaaccctgcacttgaggtcacctcactcctcttgtatgggtctctgttaaaatgagccatgatacactcccctaacagacacatatctggtctacagttggccaggtatctttgctcagaaagctgagcaaagtggaaccctctttagcacaactagtctctcacctgtagactcttcttcttcaggaattgcatcagacaattcctgtctatctgtaaactccttagtggtgctttaaagaaaaattcattggtgtgagatatgagggcaagcactatgctcttcctcatcatagaagagatgaagaattcataacacattgagaaaaaaaaattggccaggaacagtggctcaggcctgtaatcccagcactttgggaggccgaggtgggcgaatcacgagatcaggagttcgagaccagcctggccaatatagtgaaaccccatctctatgaaaaatacaaaaattagccaggtgtggtggcacacgccagtagttccacctactcgggaggctgaggcaggagagttgcttgaacccaggaggcgaaggttgcagtgagctgagatcgtgccattgcactctagcctgggtgacagagtgagactccatttcaaaaaaaaaaaattgtctacagatgattctcataacagtcctcttctaccttccaatgaacactcacctttcttacataccatggaagtgcatgacgggccagatgagcagaagccacactaagttttaaccacttcctttgcaagatcattataagtggtcttagtttacactgtccaacacagtagccacttaccgtatatggctatgtaaatttaaattttaataaaaataaaataaatgattcagttcctcgatctcattagtcctatttcacatgctcaatacctacctgtggctagcaggctaccatattggatagaaccaatatagaacgttccatcactgtaaaaagatacacaggcagagccagaactctggaacctcacttcagaaggtgaatgttttgttatctatttttttgttcccagatcttctcagatcttgggccctctgttgaagtttcaataccagaggaaaaaaatcacatttaccaatctgttacatagtaagtaaagttttagcatctgagttctggctaggaatatgtctgaacacatgaatacaagaccattttcacaattatttccaatattttattggaattttcacaaattccaataaaatattggaaataattaattagaattattaagattgagccttaagtctaaaaaaagtccactccggcagagtaaccatctccatccttcctaaccccatgacggaacacagaagagcctctaccaaagctagtctcctttatacttgtggtctttcctagtttaggaattgtctctcttttttttctgaaagcaacttccaaaactaggcagaacagttattatcatgcccatttttccaatgaggaaatggactcagggagcataaatgaacttgcccaagtttacagagccagtaactgggaaagtcaggtattcccaactcccctccttcattatgcttcttcctgaaaagcaggaaaaattcaaaatataaattccttctaacatgcagagaaagcaggaattcaaaattgaaccactgtcaaaggccaccgcaattttgatttatcactcatgtatattcttccagatacctagtatgcctagaattaaaattaaaggctattttattagcaaagtattgagaacaacctggtctgatgaagaccatgaaacacacactagagcctttccatgtccctgaacaaaattgggaaatgggttttggtctttttgagcacatttctgctttgtctttttgtatcttcatgtcatttactcaacaacattaacagagtcagtgcccaccacttgggaggacatgggaagaaatgtagcacctactagaaagagacatttaaacacagattagggtgaggaatgtcaccgacactgatactcatctacacagaggagctgtttgttcatgtttttgtaaccaggcttaacaaagaagaaaaataagaagaaatgcataggaatgagaaacagcaaattcaagacagttatatctgagaaaggacagggaaggaaattcaaatggagtccggaagcccagagtccagaagtccaaactgtcttcagaagttgggaaagttttacttctagagatggatactggctatgtgggtgttcattatactattaaaaagtggaattcttcaaaatcaattttaaaaaaatttaaaaagttactaaaggcacatttgctaaaacagattatttctgcagttcttttggtctcatttgttgaaagaaaattgtacttgtagtgtttgaagtatttttgtataataaggccaagagaagaccaaaagctagaatgttctgtgaataaggctggctttgcctagatgtactaataaaagagagatgtgaaattaaaataatattcatttagcttaaccccagccttcatatgagtcattagcacactcttgatctaggtggaggagctaaggggacataaatcaattatctgaaaatattacaaaagcattatcaactttaaaaagctttcaaaattgtaaatacacaaatgtaatacaatggtttaggttcattaataggcagaggcaccaagaaggggtgcccattctcacttcagggtcacaaaaggcttcatagagtccctcccttagtgggccttaagtgctgattagagtcctgcgtgttgtgtagccactgcttggctgccccacatgtctttgctcccctttcttctggttatggatcctgacctctggccacaagagtatatgtataactgagttccagccagtcatattcccttattccattggactcagggattggtcctgaagtgggtgtaacagccaaagagaatttatcagtatttccctgggcctgatatatagacatcaggagaaaaaaattctttgtcacctgagatgactaaactgggtttactgaggcagtaccatcacccccctccaaccacatgtaggataagccctttgacagcagaaggaaataaggccaagagtcataaggagcagaggcaagcagaaaagaaaaagagagagggcaaatagcattgaacccttgacactaatcctggtagtccaaggccatggttcttccagctccttcttcaactgtgttaggtgttgcactatccttcccagaggcacaagccaaatacttatgtgttgcttaaggttcttagagttgtgactctcttccttgtcctgattaatgcagtcactaactacattacgacattccagtcaacaatggactccaatggctcacgcctgtaatcccaacattttgggaggccaaggcaggcggatcacttgaggtcaagagttcgagaacagcctggccaacatggcaaaaccctgtctttactaaaaaaacaaaaattagctgggcatggtggtgtgtgcctgtaatcccagctactcaggaggctgagggagaaggatttcttgaacccaggaggcagagattgcagtgagctgagatcatgccactgcattccagtctgggggtcgagagcaaaactctgtctcaaaaaaaaaaaaaatggactgcatatatgatgatggtcccaaaagattaaaatactgtaattttataatactatatttactgtgttctatgtttagataaacaaatatcattgtgttatagttgcctacagtattcagtacagtaatatgctgtggtgcaggtttgtaacccaggagcaatagctatgccatatagcccaggtttggagcaggctgcaccatctaggtttgcctaagtacactgtatgatgctaacacaatgattaaataatctaatgacacactcctcagaacatatcaccattgttaagcaacatatgactgtattttgagtaagcaatccgtcaataggcagggaaaggaaggagacactgggaagagagtggaagggacacaggcatgaaggtatgaaatagtgttagagaagaaggtagcctgagttcaaaaagatggatctcttaaaaaataaagccagtgacgtaggcaaaggccaagccaagaagaccttgttttgccttgaccctcatcacaagtatcttccacttgagtctcatttccaaaaggcctttctctcaacacagtattccagcatagacacctttggctaaggaagccttgctaaatggttttattctaatggttaacaacttttgcttcatctcagatcactgacattttcataatggtctgctcaagacaaaacaattttttaatatacgtaatggatcaatcttttctgttggaacttaaggcctgagggcaggtgagctgattagacattgcaggggaaaaagcacttcccttatcccttcaaatcatgccctgtggaccacggtttactaggcctacaagccagtcttactttctctctctgactgctctttcactgtgtccaatttgccacattatcccaatgaggggtggcgttctcctgtgtcctagaaaccttaagcacacttattctatcatgattatttctcctgggaaaagaaaatgtggaaaatgtgtcttacgtttcaactaaatcacaaaatactgtcacagcctataaatgtgagttgtcactattgcgtaggaggtataatttctaaagggtacatagaaatatttagaattccttttcattgtatctacttcaagtttaagcaatcaggatattactgatgagatctgaagttgggcacagagagattataccactatactatgtcacattcattaaataacttgtactatttgttatctgatctatagataaatagagatggtctcaatgaaagtgatttatgatatttccagtttctttcacataaaatggaataactataaatggagatataatcaaataaaaaagcatggaaatgacatttaaatttgataatgcaatttgatgtgatcatatgtgcaagtatactgcatcaagacaaaaggaaataccagagcaatcatcatgcgttcagagtttatttcacatttatgttgtaagaaattatcatttaagtacctataatatggcacaggggttatatatttttgtacttaaactgttttgatatttcatggctttatttaattcagaatatagtccacacaggcttgggaacaacatcctagctggctaggatgtctggatactaatatattaacatgacagcttcatgaaaatatacaagaaacagccaattttaagtgcatatataaatatatttagtttgaatatcaactattaaagcttctaaaacaagcagtgtagtataataaagagtgtgccaaattaagagttagatcatgtttaagacaattttttttttcttgagacagggtctcactctgttgctcaggctagagtgcagtggcacaatcacggctcactgcagccttgacctcctgggctccagcaatcctctcacctcaggtaggcaatccttcttatggtcaaaaaggaaatcacttagtacagggtttctcacccttgcctattgacattttgtactggatgattatcggttgaaaggtgctatactgtgcattgtaggatgttttacagccttcctggtctctacccactacatgccagtagcacccctccagttgggacaaacaaaaatgtcatcaaatactgccaaacttcccctggcagcaaaattaatcattgacagcctctccccacattgagaaacactgacttggagaggttttatgagaccccaaatgtgttactgtttttataagttgtaaattatcttacaaatatgttatctctttatacaatgactaattttccaatctataatttgacaaattatattatatattgtacaataaatggcactgctttctaatagcaaaaactttattatgctgttggcaaaatttataaacaaagcaaggtctggcagctcttcaaaaacaggatcattctttattcacatttttttagccccagcacctaatacatttcctgacatatatgccatgtctccataaatcttttgtgaatgaaaaagaaagtcttaaaagagattttactatgcatatttttaagaatgctttaactttaataggtaccaatgaattacacatagttggcagtctaaccactaaaaaagctttcagatgtgtgtgcatggaggcagggtaaagggggcacattgcaaaatggcaaaaaatatcctaaatcaattctattatccattatgcttttctatcttgtgtgaaatattttcaaaatttcagaaaattaacaaaatcttcactgctaccagagtaatcaacatcaccaccatggatcactgagatagaactgctaattcagctctctcttacccactcttgcaaaccttccagagttttaaaaatgagaagtaagttatatcagtctcctctgcaaagaaaaaaggaaaatctcattttcttcaaatgtcccacagggctcctcaggaaccaactctcatccacatatccagcctcatctcaggctgctcatttgcacggcacccttgttcagtccctacagcctgctttcctccagtgcccaggctctttcttacttggggtttccacacagactgctcactcagctgtgagtggaagtggaaagcgtttccctccatgctttttctggccaactcttactcaattttggtttcagtttaaacgcacttccaagagccacctgccttgacaactcacattgtccccaccaccactattctaaattttgatgcacttatagcactcctatttttttttcattatatagcatttatcatatttaggatattattcatatatacctatttacctatttataattatacatttgtgtgtgtatgtatatgtgtgtgtgtgtgtgtgtgtgtgtgtgtgtgtgtatatatatacaatttatctctttttgttgattctccctaataagaaatgagggcagagattatgtcattttgtacatacagcatttattacaatacttggcatacagtaaatgcccaataagtatctgttgaagaaatgagttaataaatgagtaaatgtcacattgactttatgaaggaaaagatctggcagcaaaggtagcaattttaggatagaaaggaaatgataacatgggtaagggaagtatttgagggtcaataaggctctgggggaaccaattcctcaaatcacactgtatctgtaactatttcctccatcagtgcacaagaatggcacactgttccaataatggaacactgggcacatgggagttatttatatcctactgcttaaggtcatggccaaggtctgattttgcaattcaaaaaattgcaacctccagcataaatgggttatctttaccacaccaatattcttggtaataaacttacatttatgttctttctttaccaatattattaacaataacccactattattggtatattagtattagtatattattgataatatacctatattattatattattaatataccaataataatatattaatatgccaataataataatatctcaatataattggtaaagaagagagaaataaaataaggcttctctaccatattatttcacctatcactttattccagataatttatatctagctgcaatttatctccaaagctctaattccaaagatttcaacaccaccaatttaatatctgaattgctcctctctcatatagtgggtaccccaaactcactaaaggcaaagcttaagcaaccatcctcttctttcctactcccccatatctgctactggaacttccattcccaaagatatcctgactacggacaatggtgtcactgttgacaccctctccacagtccccaaagtcaggagtaagcaaactctatttcctctcttttgtatttctttgatctgtaccatcctctccattctggctgccatcaatctcctcccagtcctcaatcaatttcttctcaatttgaacaattgaaacagtgtcttaacaagtctttccatttggtccatgctccaacccattcttcaccctgcttcctgctgcctcattaatctttcaaagttcagcttcctgcaggctcctcctctattctgaaatcttcaaagcctgctcagtggttactgaagtaaacagaagtactttagtcagacattgaaggctctccaaaaatatgtctccacccttcttttcttctcggcatgctttccacattgcatccaaatgaaaataccccacaccttgtaatatccgagctctttactcatgcccgccctcagtgtggagggtccttttctccttctgccaaaatcccactaacttggagctctcagagtacagattatacatttctaggtgcttatcttacattgctttatattacagttggttacttggattttccttcttactgaattgttatttctttgaggttcaaggttgcgtctcacttatgtctaaactccccagaaagcttatataaacgaaagtttgcacattaagaaaaagcatgggccctgaattcagatggacttgaatgcaaagcctggctttatcacttgatataaaaaagcaaaggccctaaactctgtgagcattggtttcatcatatttagaattgattaaccagaggcttattttccaagttattgtaaagacctgatccgtaaagcatataacacaatgcaggcatgcaagaggcacccagtaaatgggagctattggaatagtagtaactattaccacattgtaatatataatcaatatatattggttaaattaaactaaaattaacataataaatctttcctgccctccaggaggatataatctaattggggaaagccacatgctaatgtaattaaccattctaagtaaaatgtaacatgaatgaatggaatcagctgtaagttccaaggttatgtgaagagaaagactgacttcctctcagggtggagaagacgtcccatgaaaaaaacacaggacctctgcaaagtctcctgcaacagggaaccaccacagaaataggcctgctctgaacaataaagggtcattctcatttgttttcatttttgttttcaaattaggcatgttttaaatgagtcattaatcatgtacttacttcactaattactcatttcttttctagctaattttttattgaaaggcatcctaaaacagggagaaaagatattgtcttgaaaaagagaataaaagtctgctcagaatcacatctcagttttttctctaagaccaagtgtcagaatctgatgtgatagtctatatgatcttaaaggtgtccttttgctcttgggacctctgtgatgtcagctccaacatggaaaatacaggaaacagctaggaaagactgtagtgatgagtcccattttcaacagattccaagtgcacacatatggtcagtctaaatagctttctccttaacacaaacagagaaaaccttgttagtgctcaacctcctgcactattcattccccaacatgcgtgatcctgtttggagttgggaatgtagggaatctggcctttctaattacctgggtactgtcacacagatcaatgtcagagtatataccataagactattgactattgaagaacaattcatggtaagtaaagtaattttaagaaagctgggaaaatgaattattgaaaatttcaaagtgtgataacacaactaactccaaaacaggaagtgaaaacaagattaaaataaaaattgatggtgaaatgttattttggactagttatgtgtgggttaccaagagtgatttaagatattttctttcctctttctccatctctctcaaaaggagaaaggcgaaagaaaacatcttaaatcaccaggtctgggctttccagatgtaattccagaaagagagaaagacagagagagagtttgggtacatagaatggtaccccaaagtatggtatgatgctttggcatactgagcacttttgaattaaaataaattgaaaagccttagaaactgcctcagaaccagggactttctaagcttctcttatttctaccacctccccaacaagtgtagaaaggtatttgctctggtatctgagtgaagaaaccttcttccaaaagaaatgcaattgtcttaagatcccctttctaagaatcttatcaactaatcaggaaaaattaaccaccagagaagagactaaaaattgtcatatgcccacaaaaccttttcacctattcttctgagggcagctgcaaaagattacctgagagactgtatctgcataataagacaacctatgttcacagtgtactttctcccctcaccttcttataacttgtccaaagactattgtttgtccttaggtcccattcagtgttcaaagggagtgatttgcaaacaattatctagtctttgagaccacgtactccccctagaaatcatttactactcctctaaactgcctatagcccctcataccactctttcctataaagaaggtatttaagccataatcatctggcccttctttgaatctgatattctctatggctcccactcttacacacattaataaatttgcatgccgtttgtcctgttgatctatttattgtcagctcacctcagtagactggagccttcagaggaggaagaaaaaatctctgcactctactattactatctatctatctatccatctatctaatctatctatatcttgaaatcttggaatcactgtgtatgttagtctgaataatgaccctaagatggccatgtcctaaacatcagtatctatgaatgttatcttatatagaaaaggggactttgcagacataattaagttaaggatcttgagtgaggagtgtatcatggattatctagttggtaaatgtaatcacaagtgtccttataagaaggagtcctagggatatttgactacagtaaacgagaaggcaatacaatcacagagacagaaattaaagtgatgcagtgaccatgctaacagcaaggggtgaactagatagcaaaaaattttaatcatgcagtgaaggaagttaggacaacccctagctgtgaggttataggaagaaaagggtcaaagagaggaactactacaaatgcacctttatgccatgtggctcagatcttcttggttggagcttttagtaataaaaaagttaaagtaggtccagaaataaggagaagctgttcaaaatgagtcaggctgctggaaaacagaggggggttcctgtgatccctctgtgtccctgcagtgggaaggaccctcgccccaggctggtgaaggtgcctagctgtgtgacatgattggcatccccagtgtgggaccatgtaaaacctacgtatctggaataaggcctctggatcttttttaaacaggactgaacaattgctccttgttttgaaaaacttttctgttgctgttggtattttcatgtccaaggcaaacagagagtcatgtggatgctcagaaattgaaaccttgcccctgttttggaagagatgtgtttcagcctgtccttcaaagggatttctcaccatgcaacctattatgttcatattttatttggaaaaatggagagaaagagaagaggaaatgcaaagaagaaggaaaggaaacagaagtatgggagcaagaaagtccaagaaagaaagagaccatcgggtgcttgtgcatgactgtctttcatatggaattaatggtggtttaatggggtatgaaaggatgttttactggaaacaacgaggaacaattgtctagctcacgtttcatttcacaggtcattattgcattaagaagtaaatcgaccaagtctggtaaataacagtctgtgtattgccgagagcttcaaaccaacaattttagccatcacaaactaatatctctgtcattttaacccttgcagggttgtgctagggggctaaacaattacagtcttcacccagttctagaaggtgagcataattcattgcccttctagtcccttcttttgcaaaacccaggaggccatattttagcattgttgttttgttgatgagccagccttagccaaatgcagctctggtggccttgaaaaacaacccccattttagtgagtgctgcaggcatctttaaacacactgcttcctctgcaaaattaattgctgcaaaatgcagtgctccctcatctaagcttttgcaagctcaaactcagctatttgggtaggtcatagatgtgtctgagagatccagggtaaatgagctgcttttctttattatagaagttcacgttcatgtcaccaaacattatcaggcactggacatacaggagtttctaatgcttaaattccggttccattaactcaggggcaattggtggatgaggccaatcctggccgtattttgaagcagttgtgtagtaaataaacacatcaaagagagtttattgtaaacaatcatacttaaaatacatatggtaaaataaagtgcatattaaaataaaattttcttgcttcaacttgggacaaaaatgtcaaagacaaaccaggctatactggccccgcaggaactggtcttaatcacctcttttctgccatcctatccatccttttacatctcttggtataccccacatgaactgacctctgttccctctaagttcccattaccgcttcatccccctccagcttcctgggccagccccatatgaactgtcaacatttcctcataatttttcaatcaaaaactgatgtttatcctacagagtggatatggaattctccacacttccacagtacctctaaaatgtggtaagtaaggtctaatttctttcttgaaagagaaaaaatcttgcagagatggcatcagtattccaatgtcttactttttttatttcaactaagactaaggtcttacaaataactatggtgtgctgaataatagcctccctaggatgcttatgccctaatcctgattatgtgaatatggcaagggactttgaagatattattaagtgtatagatcttaaagtaggaagactatcctggactataaaccttagaagcagagaactttctctggctagaattagagagttgtagtaaaggagaaggcgggagagattcaaagcatgagaggcacacaattagctattgctgattttgaagatgaagacagccgcaagtcagggaatgcaggcagccctagaagttgagcatgaagcctggcctacagtgaacaaggacacagcaaccataactgagcagcttagcagctgagcctcaaactgcattttaaacttttttttcttattttccttttcctcttttctcttccagtctcgggataaaattttgagacaaactgcatatgttactgatggaaggtatccgagttaccagcagtaaatctgtgtgggtccgcagcaacctcaatttctgcctcctcagatgaaagaacttgacagagggatataaggcagaaaaagagaccgagacaagtttcagagcaggtgaggaagtatattttaaaaggctttggaacaggagagaaaggaaagtacgcttgatagagatccaagtgggtgacttgaagaacaagtgtggtgtttcactgttaactgtgatactaggactttacagggtggcccccttctggcgtctttaaaccccttctcatgattcttcccttagggtggtctgcccacatatgcagtgccctccttacccttgggaggtgagcatgcacagtgtgttaaggaaactgtatgcatgcccatctgaggctttcttccctttgctgctggtgtgcccctggaaaggcaaactctgccatttttgtctcttagtgcatatgcccaggaagttgcttcttcctggcgtctccattcaattaacacttcagtgcaacaggtgtggcccatcaggaaatggcctcttcctggcaccatctgccaatctgtcacttttagggaggcaatgtgataattgccaaaccatcactcaacattcctagtgggtaggggagagccctcttctgccctactctatgcctgtctaacaacctataacacatctatgtaacctctcatattaaaatacagcctcagtatgtgctgtgaatctcaattccttttccttctccatacaatactcccatgccttatgcacatttatttacctaaatgcttgtcaagcacgcaccatgctttcttatctggtcatatatttccttatatactttaggagtcagatcctgatagtgacaaggcacctctggaattctctctctaacaaaagattgcttaaagatggaacccactcccagatgatgagtgactacaaaattgactgaaagtaatttataacctggcagggtctacgatggcagcatcccctttgccaaataggacaactgttcaagaggggccactggagcaagtcacgctaccttatacctctcagcccccacacttcttctgcattccaaatctttcctttaaaaacctctgtggaattgaataggggaactgaagagtggaattgctttctactcttcccctgctagcatggataataaaccaattttgcttccttttatcacaacttattattttgacttcttttcataagcagtgagcagccggactctttggccggttacacgaccacagtcctacaactacatggaactgaatctggccaagaacctgagtgagactgaaggtgaaatcatctccagaaactccagaaagaaacacaatcctgccattacctgaattttggccatcagagatctgaagcagagaaaatagccaagttcaccagacttctgacctacaaaactgtgagataatacttaggtgttgtttgaagccactacattgttaataatttgttatagcagcaatagaaaacttgtacaaaaaccaggatgtcatgctcaaatgttcatcaccattccaaccaggatcatgataagtggtggcagtggtggcaatggaatggaatagtcaagttatttagtgcttatcctatgacaggcctggggccaagttttttatatgcattttgtctacaaaattataaagctctaagatttcctttgtctgtaacgtgttcaaacagaaagacagtatatagcctacagatatggataggctggtttccacatgggcagtgcccaagaaaggttgcatcctaccaatatcacccaaaagggaagagattattattcatagccatattaaaaaatggcttcaactcccttccttcatggcaatgactttcaagaacttacattcagtttttattaatatttctcctgtgaggaagctaatcaaattgaaattcagtcatactggaagtccttaattctgtagtagaaagattggcttctaggtctaggaaaatttcttttctttggtgttcttttccttgacacactttacataataaccaactcatgtttcaagattctagttttccatataaatgagttatactatcattattcttactataaaaactaaattatacatacacatttttttaatggcaaccttctagtttttccctctgagtagtagtgctgaagatcaagatagcagaggggtaagaggcatgatatattttctttttcattttctgttttactgttttatttattcattcaacaaaaatctctaggataatgtcttaaaagtgaagttgctaagtcagaagtacagagctttaggtggtagccagatgacaaaaagctaagaaaagtgatatttgagaacgaagtttgagaactctttctccacattttccccaacactgcaaattatcacactttttaattattgcaaatatgattgggaaaataataataattatagtagcagtggtcattattgccttagaagtggtggaaatctttattaggtttatctttttaatccttataataatcatttgagtacataatattaatatctccaagtcctaaatttaaaaactgaggcataaaggagatgagcaacttgcttacaattgcacatctggttagtggacacaatccaagcagctggactcagtgcaagaactcttaacctgtgctttgattgtgagaaaactttggctttttgtatgtttattgatatttgtttcatttctctgtaaaatgtttcttggaattctttgcaaattttttcagttggtttgttcctttttgttcttaaatattagtaagttgtttttacattgatgaaattagccctttgctagatgagttgcaaatttatttctagttttttagttttgcttttaatattctttaagaagttttaattcttttatattcaaatttttaaatctacccacgtattttctagattttgattcatgcaaagaagtatccctgtaactctaaataacgtcatcaatattttctagtaattccatggggttttccatctttaatccatttaaaatttatttttgtaaagaaaaagataaaaatttctgaattgttttttctccctacatgatgagtcaaatggctcaacgttgctatttgaatgatttctattttcccataatttaaaatgctatttttgttataaactaaattgtcaaatgcatctgaatctatttccgacttttagaagtttattccatcaacatatttatttctagaatatttttaatgaatgcttccaattgtcagaaactaagattactttttacatctcatgaaaatgtaaatacataaagaaaaaactgtaaaccagacaagcgaatttttcagacccataatattgagatgagaatttgcttagtacttatttatgagctggtttggtatctattggcaaggcacaagcattttatttattggagggactgctcaagtattcccttccattaaaatgtgcatatatgcatacacatgaaaatataaaaataatgaaactgaaaatagacaaacattcatccattcatcttaggcataaaataagctcaggtttgagattctaccttctaaatttttgagaggttgaagggagggaagagggtctcactctgtcacccacgctggagtgcagtggcataatcatggctcacttcagccttgacctctcaggctcaggtgatcctcttacctcagcctcccaagtagctggtattataggtgtgcaccaccacacctggctaatactttttgttaaatttttcaatactattgtactgaaaggattaaagcagcaacgcagggttactccattattaaaacttgaagactaggaacacagcttactagtcaatgaagtccttgaaataatatgggaaaaaaagagaaaaaagaaataaactaaaataaaaagaaatagaaaatacagagccagtttattattatggcaaaaaaatcaagtaatttcatttacagataggtattcaaaaatagctcctcttgtggaacactgatattactgcttttcaaacatacaataaaacagagaaatgtgaatagatttctcataaaggattgttaacttgagtagtaaaattctcagtctcagaaaatcttgatgctttggttggaggcttgagtatttaaataatacctcctgcaaatggcaggtaatccaagtctagacaagctttgttttttaattgactgaattatatgcccaggatcaattaggtgctctctagattggtttctaattctgtgattcatttctaatcctaggaacccaggctacatctgatgaccactgacttataaaagggtaatttaccagggataaatagagtctactacatggcttaaaaaatcaattctctttaatgtgtatccctcagaacaaaggaagaaaaatatccatatgatgaatgcagctacatgtagctatttagtctttgaaatgtgactagtgcacccaaggagctaagcttcaaattatgtataattttaattaattataatttaaaatgtaaaactgataacaattattggaaaatgtttaggtatattttaaacaatgtttatatgtgattctactttttcagttgcaaagtttataaaatataggcaaagatcaaatacttttgataaaaacactttataaattgacatggcataacagtaaaaagcacaacagattttaaacacatagtataagaaacataatgcaaaatatctcaactacactgattacatattaaaatgatgatttttaaatatattgagctgtttctttttactgcttttagcctggatgctaagatactaagtcacactggtgcattatatttcttttgaacaatactgttctggatggttaatattcagttcttattcctagatttagaaaaaaatcactgaaaactgaagatcatcaaaaatatgccagtccttcataaaaatatcaaaaatttgtggatcaaaaaactctatcaacagagtgaaaaggaaacctgaagtatggggggaaatatttgcaaatcatatgtctagtaaaggattaatatccacaacataaaccacaactcctaagattcaacaataacaaaaaaacccaaacagcccaattcaaaaattaatatgggacttgaatagacatttctccaaaaaagatattcaaattaacaatgactccatgaaaagatgttcaacactactaatcacttgggaaatgcaaatcaaaattacaacgacatatcacctcacacccattaaaatggttactatcaaagtagaaaatttcaagtgtcaacaaggatgtggagaaaccattgtgtactgttggtgggaatgtaaaatggtacagttattgtgggaaacaacattatggttccacaaaaggttgaaaatagaactatcacatgaccttgctatttcacttctggatctatacccaatagaattgaaagtagagtctctaagagatatttgtataccatattcatagtagcattatttacaatagctaaaacatggaagcattccaggtgtccatgggtggatgaatggataagcaaaatgtggtaagttcatgcaatggaatgaaattccataatatgctacaacatggatgaaccctgagaacattatgctaaaagaaataagccagtaccaaaaggtattgtatgattctacttatatgaggtacttaagggtagtcaaaatcatagacccagagagtggaatgttggttttcaggaacacggggtagggaagaatgggaagttactgtttaatgacattagagtttcagttttaagagttgaaaagacttatggagaagtatggtagtgatggttgcacaatactatgaatgtatttaataccactgaactgtacacttaaaaatggttaagatgggccaggcacagtgactcacacctgtaatcccagtactttgggagaacgagatgggcggatcacaaggtcaggagacctagatcatcctggctaacacagtgaaaccctgtctctactaaaaatacaaaaaattagccgggcgtggtggtgggagcctgtagtcccagctactgaggctgaggcaggagaatggtgtgaacccaggaggcggagcttgcagtgagctgagatcacaccactgcactccagcctgaggacagagggagactccctctcaaaaaaaaaaaaaaatggttaagatggtaaattttatattatatgtattttaccacaataaaaacataagccagtctaaaaagtgaagaactaaaaaaatgtcatatattggctgatagaaggaatttagaattcctatgcttgaaaaagtcttatttggcttattataaaatcattgtcttactgtctttgaatatgtaaaatgctgtaatacagaaagacttatatgaaacctggaaagacttatactctgtcatgccaaaaggcaaactaggtcactgggtagaagtcatagaaggaagagcctaacaataacaagttattcaaaatataatataggcagccttaaaagggtgtgaactcccacttcctgggaaaatgaaaggtaaagggcacgtatgcatgtgaagtgaagctgattgatcttcaagggaccatccaaatcaaaggcactacaatcttgtcatttctttccaagtagcatgtattcctgtagactaatagattaacatgaggcaatatttcccagaatgtgttctgaagtacactagttccaagggaccctaatgtgtagtatgaacaggtattctctagtcaaaaagcttgggaaacaccgggtaacacaaaattaaacagtgtttttaaaaatttaattgcagaacttatcagaatcttcagtattttaatacacatggtggtctccaaaataggaatagtcagagttttcaaaatttatttggccatgtaccacattttttacaatctcctgaaattagaaaatgggggaatattctttgaaaatgctaaaacaaattatgcattaattaaatctataaaatttactttgtggaagagttgactggcaaactaaacttaaattcttgactttcttattcacatttgttccctcattcagcaaacattaacaaagcctatattatgttccataaattgtactagaaattcaaagacatttaccttgaagtcactcacagtctggtaagaaagcagacttgtaaaatgatggcggtaacccacgagaggggctgtaatggagctgagcaacgggtgaaggagagtcacaaaggtcctccatattcctgagttctgcatcagtggatttgatcaaaaatccgctgatcagatcaaaaactgcagatcaaaaatatgtggaggaaaaaaaaaaactctacaaagttccaaacagaagtttcacttgattttgattttgccacctgacgagtactatgttgaatccacacaaacgaagtgatgtgttagccatcttattaggtattataagtaatcgacacacgatttaaagtgtacaggagaatgtatgtagattagatgcaaacactacacctttttaatataagacttgagcatctgtggattttggtatctgtaggggtcctagaaccaatgccacatggatgtttaggaatagctgtatatatattatgtatgaagaagaggaactaaatgagtttttttgtggttgttatagcatcgcccttcaaaaatgttaaagtagtcgacagttacttgttaaactctaaaaatctatttgctaccaagtaaagtaaaaatatgtgaatgatccagttaaatatatctctgtatagagtcctaccagatgattcagaccacacaatgataattatccagaagtggttatgaactctggctttggagtcagacaaatatagatttaaatcttggttctgcacattctaactgtgggactgtgaaaaattagttaacttctccaaacctctattttcccaaatgtgaaggggtataacgatcccttcatgttaaggttgttgtaaggataaatgagagtatttataaactatttagcataatgcctggcacatggaatgcactagataatggcaattattattattgctagtttgtttggataattgctagaataattgtacaatctcagttttgtttgttctgtgtggacagagctttgtatgcgatgaaagctgacagatctaaaacagttaacactgaagaatataaagaaagaaggagaaaacttggatagagggtactgggtagtatagcatagtcttaaaaacacagttcggggctgggcatggtgactcatgcccataattgcagcactttgggaggccaaggtaagaggatcgcttgagaccaggagttcaagaccagcctggccaatatagtgagacctcatctctacgaaaaattttttttaaaaaaaactagccaggtgtggtgacatgtgcctgtagtcacagctacttggaaggctgaggtgggaggatcacttgagcccaggagttgaaggttgtagtgagctatgattgtaccactgcactctggcctgggcgacagagtgagaccttgtttctaaaaataaaaaataaaaataaaaacacagttcaatctgaaccttgttaattagctttaggacttggacaatttacctaatgtctacatcagttcccacacctataaaatggaggcaacaggactatctcttagagtagaacccgttgatggcattaaatgaggtaactcattgaaaggtcacagcacagagccagaaatatggtggacactcagcaagtgttagatgctgttattgttaatggaagatttgaggagcaagacaatcacaataataacatgtctagattgaggaaaggaaaaggaaattgtccccatagatcacatgcctgttcatatcatcttttatagatcacacatgaaaatcattccaactcacagcatggactactttgaaatgtaatcaaatattgttatggcattcactgcctggagaccaggcaagtcatgagggagtgacaaaataaggtgaaggaaaggtactctttgggtctgaacgatgtaccactagaagccgtatccccccctgcttgggattaaaatcccttgcagctgcgaatcccaaagagtctaatattttctgagactccactgtgcctttatattttaataccatgacatctggaatcctaaaagtctaatgtttaaccataaatatctgctgaaattaaagagctatataccaagcttcaatctttggggcctgtaattgcttgggaaaagagaatggtattttcccctctagctagaagaaaaagacctctgcaagcacagatattggcagacaaattttctaaccgtttcctctctccattctgtcctctcattttctccctccctctccaatctcccattttataataccatcttgctgtcattctcaggataaatgggaaaaaagagaagcctagaaaccttaaagaaaagacacatttcaaggtctagcaacaaaaagttgagaaactgcaagccactctctgttaagtagctgagcagacgtcaccacaatacctgagctttccccattattcagttagaaaccacttcatcactcagtgggctgacagtcaaatgccagctttattttcttttttttatcaacctaatcttttatttttgatttgaggccagtcacttttaaggtctccacagtggtttataactttctttcttgagaagtgtccaagaagtaacacaatttgaaaaatgttccctactgtctcatggtaaagaatgggaaactcacctgccctgaaggtgtatgtggtcagaaatcttggtcagaccacagtactttgctggaaataatgccaaggaaagtgtgggaaaagcttatcgtgagtttatatttttaatataactattctatgtggcatttaaaacatacacttagtatcaaacccatttttatccactgatatattatgaaagtgacattttgaggtcagtcacctcacttctaggaaaaatgatccatttaaaaagaggtttaatatgttgtttttattcaaataattaagattgtaaatattcctgaatctttttagctaatgttcttttctcttgtggaaatatattcagtgtgttcataagcaagtatgtttatatctgttggtatttggcacagagagctaattcttgattattcatgaaaatttgaaactatccactcactaaattaaaaatattgtcttcttaatatcttgtttatttacttcaaaaggaacatataactctatagtgatgattctcaagcctaacacagcagaatcacttattgtttgtgtgtgtgtgagtgtgtgtgtgtgtgtgtgtgtgtttaactcaaaggtctggactttacacacatctattgattcaaaatctccctacatgccaatgaatgtttaatgtcctagatgatcctaatgataagtcagttttagtagctagtgtcctgaccacatcataaaaaaatattggcaggagaatgaggggggtttgttttgttttaaaattttcagtctattgaagagtaataatttaaaaaaatacaaataatcagacaaattagatatacaaactataagccccacgtttacttattagactcaacagacataaaattactctgccaaattgctgtgtttctaagtggtaaatttctgtgaatacctcactgtagacaggtagccgatagtttgtgggccagcacgcgtggagcagctacctccaagccccacctgctccccttccacctgcacagcttcctggctgcactgcccgcctccagacagctagcgcactccaacacagctagcacaatcttttcagggagcaaggaaaatcctactgccacctttcttaaaatctcccaaaatatatagaaataggaaataaaactgtggttaacagagacaggggtttgggagtgagaggaaatgaggggatgttggtcaaaggacacagagttgcagatatgtaaggatatgtaaggcgaataagtccagaggtgtaattcacaacgtgaggaccctaggttaataatactgtgttgtagtcacgatttttgctaatactatgaattataggtgctcttgtcacaaaaagtaggggtggttaaccatgtgagatgatggatatgttcatttgcttcactatagtagtcattttactatgtgtaagagtatcaaaacatcatgctgtacatctgaaatgtacactaaataaataaattgaaataaaatccaaaccttttactctggccaagaaagaggctggctcctgtctatctgcaactgcttcttctctcaaaaactgcacacagtggtctcctttccacccacctctcacacatgctgaggcccttttggatctcagagtccctgccctggctgctccctctgcctggaagtctcctccctctgctcagggcaggcactcctcactccccattcaggtctcatttgaaatgcaactatttcaaatagcaattcgcctgcacacaagacacacacacacacagacaactcaaactacctttctagcccaaaacactattgtattttttccatccttctcatctctcctggaatgtgtgtgtgtgtgtgtatgtactttatatatatatattttttattttatatatacgtattttatatattttttatatattttaatatgtattttatatatatttatatatttttttacatatatataaaatacatacatacacacatataaaatatactcatgttatatacatacacatacacatatatatgtgtgcatgtgtatgtacatgtattatatatataatatatataattgttttagagacaggtctcactctgtcaaccaggctggagtgcagtggcgtcatcttggctcactgtaacccccgcctcccgggttcaagcgattttcatccctcagcctcctgagtagctgggatcacaggcatgtgccatcatacctggctaatttttctatttttagtagagacggattttcatcacattggccatgctggtctccaactcccaactttgggtgatctgcctgcctcagcctcccaaagtgctaggattataggcatgagccacagatcccagaatattttttatttggaattttgtttatgtacctctggaatttttatttgtttatgtacctaaccctactggaacataagtttgatggcagcagaaatgttgttttgctcattgctatagtttccatgcttagagacgctctggtagacagaaagtaggcaaaatacacttgccaaatgaatgaaaatgccaatttcagcgtgtagcataaaaaaggtgctcatgcaatgctagttttcattttacctcccttccacttttttttttgtcatggctgagaaattgttaaattctgttgaaactgaagctctgatttctttctgctgcctcctgacactgctggtgccccacatgtgtgaaccggggtgtgaggttatgccatccatttgtagtctgggacagacggaaactgagtttggagccagaatggaaagctttggtatctgcctaattctacctgaatgggacattaatttcaatgctttgttcttctaaatgattttgaatgttcagatcatcagatgcctccataatcaaaagaaatcctttcgagaataaaatgtaaatggttctcagaagatcacctgcttggcatgagctgtcttgctctctactgttatacatttttccaagttggctgcacatgcaaacttacagataagtataaatcaaaattagcagctctcttctcccctggctacacatcctgcattacacagatagcaaaacccactggcagagtgttcctcagagctgatccacatggatggtttttgctcctaatatgacaatatgctgggacctgtggatatctgtctgggtgagtagtttttgtacgaacttatatgtgcaaataaaatctgttattttccaaattaaaaataaacctcaaaggcaatggattccaaatgacttggagagatatgtttaaaaaaatatggaaaggatataagggtctgttaaactcaatgacatttggaataaatataaaattccagtggtctccatcttcaccttagctgcattgctttctctgatttactgaagatgataatagattcttgtcttgaactgaaaaaatacaaaatagtcattaattatcctaagattaaatctgtgcttttttcatccaacagactgtggacagtaactgcaaagtagctaagagaaaatggtttaataatgaaaagaaatttgcattaaggaagaagggatttactcatactttggaagtcaaagaaaaatactgcaatcctgtcagcacccggaaggcaccatttactatgtgctgtctctttcattgcaagaggacacagattgtatttttagtgcagtaaacagcagattccactgtgggaatccttgcagttggtacctatagcaacctcatttaaaatgttataaagctctaaaacatcaggggtttaggcaatcagtcatatatacctccatacagacattcagccactcacacacatacatgcttgtccacacactgatagtaaatcgtgtgtaatatgatattactcatggagttttaccattgaatcatgtttgacagccatggtaaagaactgagaaaaagcaaatattctaccattgcaaccagcagcaagaacatatttgtgcctaaatagcatattacaccatctggtaagcaaccacctaaaatgaacactcttatgattaaacatggagaatctgactgacattttagagtttctatttgtaagggatgcttttgatgccacacccatgtatttttggcactcaccttcatacaccaaaggctgctaccacaaaacctatgacttccttctgaaaaagctttttttcttttgataattttggtatcaatgtttttctcttttttttttccttctgagagtttttggtggcctcaaggaagagcacagttagcctgtgttcagagaaagccaaagggctggagagttaatgtccccaaagcatcccccaaagtcctgacagaaaagaaaggtaagctccaagacaggggagccaggatttgaaatattaacacatgagcttccctgtggcttggctgggataatttggggtgctgttcccatggtctcccgcagttccctatcagacttgagcgccagcttccacagtggtaaccagtttgataacacttcccttattggccttatttcttttcctaggatacttcctcattttcctactggtgttttataggatcgccccccattaaactacttggattctaagccttgtatcagggtctgcttctgggacaacccaaactaagacactatcttcagtctttattcccttctgttaggataaaatataattttcatcaaatactctggaacatacatcccttatggattccaaagaaatgggatcctcaccaaaagctcaagtccagaaaagtcccacaattaggcatgtgcttattttaacatatcagaatgttttccccatagcataaatacctgtaatggtggaataattcttaaaaccaatagaaaacttactatagaacaccatttgagtagatctaggggtaaataggagggtaaccccttatcttttcttcttttgctactttctttttagtgctacccacatattttctcagtataaatgtgtccctgaatttcattcttctgtgcaaaaaatatatttgctggttctattcaacaaatgcaaccaacacattaaaacgaacatttattcagcatttccatgcgcttggcactgactttaaaaccaatactgtagtccttacagcttttcactctattccagagataagccttcaacatatggaaaaacataaaataaatgttaaaaagtataaatattcaagcatgaaattttatggtaattaaaagaatcatatgtagaaacagctccaaatgtcaaatgctgtactgtagcagtagttcaggtgaaagaaaggtgaaaacaagtaaaaagatacatagaactgtctgcattttaggctttcatattacagataaattcttaaaccaatgacctgaaggcctcagttcattctgcatgctcttggatgacgtgtaacagcaaactcttctggctggttacttataatccattcatttgatcagtcaaccaaaatttattgagtaacccccaaatacacatcagtgaacaacaaaaaaaaaatcctgccctcatgaagtttgtgttctaaaaaggataaacagtacattaacataagcaattacatttataatataatgttaagtaccacgactctaacaaacaataaagcaagcacagtagagctacagaaaaatgatctcatgattattttagatagggtggtcaaggatggcttctctgagggtaccttatttgaacagcgggaactagctcccaaagaagtgagaataaaatattccaggaagaggaaaaagccagcacaaacgccctgatgtagtgatacacataccatgttaaacgaaaaataagagaccaggataagtaagtaaaaggcgtgtcacaagagaggaggtgagagagtgggcaggaaccaggggctacaagacttacaggcttgtagctgggacttcattctgaatgggtggaaagctgaaaatatccctctggccatgtgtgaagaatagactagagactacaaaagtagaagaaagaagaccagcaaggaggctattccctcatctagtgagagacaatggtggctagtagtaaagggaatggtgagggtggtagtagtggaggaaatgagaagtttgagaatttgggttaggaaaaagaaaaataaaagatgactcccaggttttttacttaaatagcctaatgaatggtggcaccaattactgaggtagggacagctaggcaagaagcaggttgtagattggggaagagatcaagaatctttttgaggcatattgagtctgagatgtctactatctttccaagtaaagtcagttggctatactagaccaaatttcagggtcgagtctaggctgaggatataaattggaagtcatcagcatttgatggtatttcagtcttggtcctggggagcaaaattagagaaagaaggaaaaaggtctcaggacatagtcctgtgaaagtcacacattcaaaaatttaaaaggacaagggagaccagaaaagaaatctaaaaagaatcaactaatgagatagggagaaaacagaaaaacttctttacatttgaccggagcaggttccagctgaacacaaatgagaattcagagtcagcttgttagtggaaataaaaagacaatgatctctccaggggtccagccataaaaattgacataaaagggtgctttgtttgcataagcaagaagaggaagaagtttggagcacagccttgtttgggggagagttggagaatggagaaaagggagacaaaacacatgacatctaccctaccattgagagagcgctttaagtcctgacagaaaagaaaggtaagcttaaagaaaaaggagctggttccatggcagaccagtatgaaacactgagcatgatggctgcttcaggcccaagtgcccaagctgggcgagaactgtcctcccagctgtgcactaagttgggcattgagaatctgcacttttgacatggacacaggcaatctcatagagggcacagcagtaaagttgtgagatcacataatgactcagcattcctgtaatacaggtgaattggcagcagattagcacagactccaactctagaatttaggtcttcaccagtacatttcattctcagtgagcacagcaaaaccagctccttcacaagcacccttgcctctaccacaggcattgcattcagatatagcttacctgcgttgaagaaggatgcagtccattctgcctctgttttaggaaatacagaaactggtggaggcagacccagggctctcccatccagatccttgaagagatattttcttggacttgcacagtctaattcaggacagactacttttcctaaatctttcctgtgaagacagtcaaaaagcaactctttcatttcatgataagcagcaagaagaaaatatacattggtagtgctaatgttgtttaaaataaattcaacagatttttattattgacaatgtgttacatagatataaaataaaactctttatgaaataatttatttcccaattatatggtcaagaagaaagacattcttactaaccaaatattttggatatcctaatatgtaatctttatatagattgctgattttttaagaagcaagatacaataaagtgttcctctcataacaactgaacataatataattatttttaggaatttcaggggtttgcagtattttagaattattataaatatcaattatatttatgctatatgcaaagaaaaatagatattctcattcaacaaatatctattgaaaacctacaaaagacaggctgggtaacatgatggtaataaagccaaacatggcactgcactttcagaatttagagtcaagtgggctatataaacaattaatagataattataatgttgacttacagagaacttattttatttcccctaatctaatgctttgaaataccattagtaataatattaaatatttattgtataccaacaatgtattgagtattatcagcacaaagattcagctgttaatatcacatagtactatgatttgaatgatggtcctttcaaatttcatgttgaaacttaatccttaatgaaacagtattaagaagtgtggcctttgggaagtgataaagctatgaggattcaattctcatgaataagatagtacccttataaaagggcttgaggatgaagagagtactctcttgcccttccatttcttctcctatgtgagaacacagcgtttctcccctctggaagatgcacgaacaaggcaccatcttggaaggagggagaaaccttcaccagacgcctattatgccagtgtttgatcttggactccccagcctccagaactataagaaataaatttatgtccaggtgcagtggttcagcctgtaatcccaaaactttgggaggctgaggcgggaggatcacttgagctcaggaggtcaaggctgcagttagccatgattgtgccactgcacttcaacctgggtgacacagtgagaccccatctccaaaaataaaataaataaatttctgttcttcataaattatccagtctgtggtactttgttatagcagcacaaacagactaagacatgtaacttaacagctatatcagcccgggataagacatgaacataaggaaaattggatagtaaattttaaaaagtgacaaaacaacacaaattgcctacctactcatgtttaggtacctaatcatgattcagggataggcatcaaaaagagactcgtgttaagccaaacacatgaatgttctaattagggtggcttctttagttttttgctttgtttttttttcttccaataaaggagtttgccccagtgttgtgggaaagaaaaagtaattcattcttcctgtttctaactttctactctctttcatggcataaaaaaatcctatctaattttcacatatttgaatgaaactcttagatcatatgtcagaaaacagtatttacacctggtctgaaataccaatatctgctagacctcatcgttcagttcagagattcctgtcagcagacacaatctccttctatctactagttcctgcacaaaaggctcccaaggtctccttctgaagaccactgacactttactccaatgaagaatgaagaattagagtcaatttattaccagcaagtttgaaaacatcccaaagaagtctctctaattaagacaaaacaataaaacaatatcaataaaacttgcacttcattacttctgcctctttcatcagctaaagaaaatcacatggctgagtccagattcaagggggagggaaatagcccctgcctctttagtgagagatattttaaaaatcatatatcacaaggcgtgaatataggaggggtaaagaattggtcattaagttaatgtaccttaccattctaagattcatttctatttctttgatgattttattcctttcaaaaaacatgtttagggtttgaagaattgccaagtacttcataaatatggcttattataaatactaaaaattatacctgggttgtaatgaaggaaagtagaacttgtttttatcttttatctttagcatcctggtcctctctgctgttattgggtgcataattccactgttctctgcatttggtagaatgcagacatccaggtcatcgctatagcaactcttcacaaaactagaaaaggtaacatctgaaattttaaaaatatgtatcataatattatatcatataaaccaccagccacaaatatcgaatatacaactaaatattgttataataatgtataccctaagttagttaaagctatccaggatagccttaggagtttacatacatcttgatataaaatatcagtagttcttcaatacatggacattgcatgcaacagagaagagtatttcaatacgttaaacctttaagagcaatatggcttttcatttgaggcttaatcaaaatccattcattttacagaaagacaaacccactgccagataaactaagtaacaggggagagactacaatggtggtacaagagatctaatagaagatgaactgcaccagtcgtgtcacaactttgattttaaccctcgttgctcaaccatctactaagcaacttcagatgagacacaacttctacatttcaatttcctcacttgtataataggaaaaataacacctaaccaagagagttcttatgtaatcaagttaaataattgctgtgttagccgggagtggtggcttatgcctgtaatcccaacactttgggaggctgagatgggaggactgcttgaggccaggagtttgagaccagcctggtcaagatagcaagatcccatctcattatattcaaattttttaaattttattaaaaaataatagttgttgtagaaagctcttcaatatgtataaagcagtgacttttgtaagaaattataaactaccattgtggctatcaatactcagcaggttggacagcaagcactagaccacaatgtacctttttgttgataaaatttcagaatgccattaaaaattttatgcatggatgtatgaaatggcactgcctagataaaataaaacatcctaccttgaagtttcatgattcctgaaattgaatgatcattcctcactttgtgccatggctcctgaggccactgatttggttctgaggtgaatacaggccacagaataccaattcgacctcctcttggattggagggagctctatctgttgatgtcaagttggctgagtgcggcttcactttgtcctgaatgcagtcaaaagaagagctggtggccacaatgactgaattcctaagcacaatctgcacttttttgacggaattttgtggagcagaaaatacatacactactgccaaaagaccaatagtattgtctaccagagtaatgttctctatctccacgctgttctctacatgtaacatggcaccatagtcaaagttcttgaaagccaagaagccagagattctggtacagttgtcaagtccactttccttatagagatgaaggccatgaagacttgaatgcgccacattgtcagaccaaagcagttcacaagaggagcacttgtggcctcggatgtgaaagccaagtctctctgatcctgccacaacgttgccatggaggttgatgtcctttacctggttcactttgattcccgccacccaaatggtggaccacgctggctgtgtcatcagaaccacaaggttattagtgacagtataggcctgaccctctaaatctatgccatggccagctgtgccaaacacaatattgtcatttaaaagtactccatgactggcagctgcatgaatgcccccgccacagctctggtgcagagtagatgatatgatccaggatcctgctgacacattactgaattcaacagatgagtacaatggtgacccgaagttctgaatttccacattaagaagttgaaggacacctataaacaaatgcatgtcatcaggtactttcctcttccccacaaaaggctgaagaatggcccattttggggcattaagatatgaacatttttaatgaaaatgtaagtttattctcaacaccaacattatatttcacaccatagattctcaactaaaaatgtaggaatcattacaagtatcacattaatgcctgaattgcatgtgcagtctgaagagtctggtgacaggacagggaaagatgagaggagaaataggaaagaggcaaactttggggatgggcatggccaagtttaacgattctgtgtatttgtcgggggccgggtcaaagaactgggtaagaatagattctgggtttctggcccttcacctcaaagtcaagtctccctctcagtgtctcagtgacaccacgtgaaaggccacagccattcccaagaagacactgcacaaatgaatattaagcatttctgaagaagagtatgagtgcgaaatttccttctgctcagttgatgtccagaagcctgatattccatacatgcttctgattaaaacatggtaggagcaataacatgcttttaaaatcactttaaagattctgtaaaatgttttctatatttttatcctgactacactttattcactgtttcatttttataagattttctatatcttttatgtgaggagaaaatagtgaattatttactctcatttgtagttttatttgtactgttttaaatagatattgttaaaacacactataaaatacacccagtaagttgatttaaaaatacaatgattcagcatacatacttttggtaaaattaataataacatgattatagatgaattaatatgcaataataatgaggtgaattaaatactttaactctcacataacactcattatttgcagacaccgttctaattcttattcatttatttattcatactcctaattttcaaaaaaatcctatgaggtaggtacaattattatccccattttacagataaggaaattgaggcagagaagagtgaactaacaaactaggacttaaacttaggcatatggatgagaagccgcactattaaccccatgcaggcatcctggaaagacagaaagactttgtggtacaaaagtagcatctctgcattatgattcagataactgccctatagctatgagccaataattagttgtgtgtcctttgctaggtaggtcacaactttggctccttttatttcatttttaaggtactgactaaagtaaactataaagttatttatctcattaaaaataaaggaagcaatacatttgaagtttctgtttcactgtttcaataatagtattaatagtatttaagtttcaaaggcagtacagcctaaacccctcatttctccactaccttttcagaaatgagaaactagaacccttgcaaatcggctgccatgaagaagcaagtccttttgagaaagacaggctaagtaaaggaacctatacgtctacttggggccaggcaacaggattccgaagtatctaaatttctcaatgggtgctattgaggaggcattcgtagatggtgtggacatattcacagaacaataaaacatccaaaagctatttcttgggcaatatccctcaccaatagcacatagctgaaagagctggcaaacctgcttcgtagaactttggcacaaagaacaccaaatgcaagcataagtccataaataaatagcttatttttagcatttaatgtgattttagaatctctgtcaaggcaacatgtcagtattattgttatttcctaggtttcttataaatgatattacaagggagataaataaagagatgtgtagggcacggcatgagggaagggcatgcagctcccattccctccccgggtgcgccaccttagtctaggaagctccacatgttcggctatccagaagctctcaggattattttaattatcagtttttttaatgtcttatgcttccatggatttgattcatagttttaaactgtacaaggtctttttactgctgtgcacattaaccaatgactgaaaattaatcaattagtaaagacttaaaatgtcttgagcattaaataaagaattaagcaattttttttgagatggagtttcactctgttacccacactggaatgcagtggcatgatctcagctcactgcaacctccatctccagggtgcaagtgatcctaccacctcagcctcccaagtagctgggactacaggtgcatgccaccatgcttggctaatttttatatttttagtagaggcagggtttcaccatgttggccaagctggtatcgaactcctgacctcaagtgacctgcccacttcagcctcccaaagtgctaggattaaaggcatgagccacagtgcccagcctgaatgaagcaattattttattcacaactattttcctatttttccttttgaaaatcactactgaaaaatatttcagcaagttaagtacaacttgctgggtattattcaggaagagaagaatgatggagccctccaatataaaagtaggactcaaaagtcttggcctgcttttctggtctataacaaatcagtacccatatctgccatccctgacctacacctgcagatcccttcttattcaggccctggactatgttatagaaaaatgtaagcattcttaatgcagggtataaacctgaattgaattctggaacagaaaaaaactgataaaatttgaagaaagtcttgagtttagttcatggtcatgtaccaatgttaatgtctttgttttgacaaatatactagtattatatcagctattaatggaagaaaattgagtgaaaggtatacaggatctctctatactacctttgcagcttttctataaatccaaaattattacaaaattaaaagtttaattaacaagaaccaggctcgaatctaccacttactacttgaatgactttccttactcttcattaatatttttcattcatatttattaagtacctaatgtacagcagttaccacactaggaaaacagatgaaagacctatttttcacctcaaggagtttataagctaatgaaggagctacataaataaataggcaattgtactatagactctatttcctgtaataggaatataaatttctcttatgaggattttaggattaaataagataaaattttcactgtatgaaaaccagcacagtttctggtccacaagaaacacaaaatagagtttctgtttcccttccccaggggatgatttaaggatcagcattgttagaagtttaggatcaggtcagtcttgctgctggttctgctctggcttggtgctcagctgtaagaactggccttctgtcctgttcctgtgaccatgctccagcttgccctgtggcttcagttaactgggggcttatcttgctctctccttcctgattccccatcttcctcaaccttagaatggggttcttaaaagaatggttcaattcttaaaagatttgaaccagcctttgtctccatcatctagagcagggttctcaacctcaacactattgacatttggagccagatactcctttcctatgggtggtcgtcctgtgcatgcaagatgtttggcactacccatacatgccagaagctccctcaagttgtgacaagtaaaaatgtctctagatattgccaaatatcacctggggtagcgggcagaaatcaccactgataacggcttatggagacagagcttgctctattaactagaaatcttaaatgtctgatttaaggtccaaacactgccctttacaaaactggtaaaatagttgtgccaacaaagagtgtcccatactgaatatatttgggaagtgtttagatcctttattctcggccttctccaggcctttatatattcatgtacaccacgattttataagttggagctacagtgacaaccaaactatttgatcaggaaagaactttggaataatgtataaggaacacaagtttaagaaacgaggtcctaatcaaataattttgcagcattccaaaagggctaaaacttgaaagaaacaagaaagattgaactgatccttaaagcagtctgaaatatggaaatcatttttatttaaatttacgctattaatttatagcatgaactgatgcctgccatcagatatagcatgctactgggaaagagtaacagaaattcaggaaagagataaaattgaagtggtcattaaatcatctataatttcaaagcagtggaaatttcacatctgctgaagatgttttctttgaggtaaaatgtgcatatgtgctgaccactagtatattattttaacatcacactgataattaagcacagattaggactgaaaattcatagcttctccaagcacaaaggaactatctcatttgaacattttgttttataaatgaaaattctcacagttgggatttctgggtgtcccagatgaataggctccaactggtaatggccaattacttaaaatttcatttacctgaaaattcttctcggctggacttcctgaaggaccccacaaacagtctccccctacatgatacgtcaggctgaatttgtatatttcgggtcaacagtccaacctcagcagccaaacgaatgtgtcggccatcctccgtgacatgtacacttcctggggcaataggagttgtgggaaaaaaaaactttaaaaacctgtttcaaaaatcactagctggggacccagcaaacctgagaaatgaaaacatcctttcccctcagaagttctaccaacattaaggtctgcttttcctggggcattctccacaaaggtcagctgagaaataaaataacccattcacttgtctctctttgggatcagagtcagagtgtttgagcaagaattcatttcttcttaataactgtgggtactggaacaggtcactggttcagggaagtcagggcagacctgtccaattagtggggtccccaacctgccttaaataggtcagcgtgagacttcagtgttgggttgtacattgtccgtggacctctttcatgagagtgaggagtcccacatcaactgaggcagtgacagagcaaaagcagctgtgtgtaaaaggaaagcgagaagcagcaccaggcagcagcagcgccctctcatggtggatcttccactcatcacggcctgaacagcttccacagcagtgggaactaagcgtcttgctagtttgtttcactgtctaccatttgcatttcaccttgcattttactgaaatcattgctgaagatttcttttttctttgccacttactaaaaaagaaatgctcctgggaacattgatttagacagagctttagatattcctggtgaaaccatggatttgcctctcaagtatcagagacaaaaagacattctccatcccctttatttccacagtttattactgattagctatatctcctggattagatttatttattagactgaatcaggaaggttattgtgatttattatttatatgtagtacattctaactgtgtattgtgtataaaaatatttggtaccttttttatttaaaaaaaggtctgggcttttttctttcattttttgcagtaatagtaatagtagtagttaatacataaaatgtacttcatgtcaggaaggacacatttctaagtatggaaaatgaaatcattatttacagtaactacaatattctaagggattataattcaatgtgtcaggaaataaactggaaactcagtgcccataagttttattctggcttagccagaaaactgcccagtgaccttgaacaagactctcaacccttctgctcttagatttgccattataaataaaaagcaaaatgtgtgtgcatgtgtatgtgtgtatgtgtataacatccaagtattctttaaaaataaagcaacaaaattaatgagggaatagagataaggccacgtagcatgagtctaggtcaacaggaaggcattgttcttcccctctgaatggcaatcagatccgaggtccccagctaggttaccaaacatggtcttcctagctcattcacttaccttaaccaacaaaccaaagccttaccaatatgccggtgtttgagccgttcatagatcctcacatggtggcccttgacttctttcacagtgaggacctctgcttcatgaggctcataagaagaggagctaaggactattttgtcatgggggcgccaatccactgcatcttctactataattctgtaacagcataacaatggcattggatatactaacagtgcagcacaaatcatctattaactccagagcaagaaaaggaaatccactgtgaccaacatatcccaccagagaaactgaaatagaaataagacatggcagtggaaaaaggctttcgcaaacagtttaatttagctaatggagtcagttttctggcttgaaaatgtatatgttacagagacagtgaagatattcgatgacccctgaaatacagcaaaggaataaaaaacaataaaagttccagaggttagtacacatgtctacatcagcaaccttctttctggattagggaacagattcaataataacagcatttcagaaaagaacttttctctaattttctagagaaatataatgccattttttgacaactttggacattttggacaacttttcatcatgtgttacaaatcctaccttcatgatgaaacagatacaagtgtgaatcgtagaggtgtcacttaccagctgtgtgaccttgagaagtcacttcactcctcggcttcatatcctcatctgaaaaggctatatttgtactttctgtcttctctttcatcacattatgaaacaatgagggttgtgttcatttttggtatttttcaagacacacatttaatacagtttctgttcagtctttcactgccgcctagcattccctctgaatatgactgttttattttcttcatagtcattaccaacttcaacaccataaatttaattgcctgcttcattagctaatgcccaaagtttagcaagctttgataaagagtctcctctatagtgaatgttcattcagacaacagtgtccatgtgcagggcattcaatcatgcaacctttattgaccgagcaaatcttatgcaccagacaatagagtagatgctagagacatacgataaataaaacatatgtcatttgtattaaaatacataacttaaattctgcctagcacatatctttaaagagtctactgtatgggtgtgtattacacagtattctgtgtaataccatgggagtacatattaataatacagatgtttaatatatagtattaagcccctaaaaggaaacataaattaaacctaatcatttgcaagccaatggcatgagtctaataaatgaaatattataattaattcacatctacgtacctaaggttggagaaagagtcatagagaagacaaaaaaactactatcaattgatgcaactttaatgaaggaatttagagtcttagctctgttcctgatttgctatgacttcctagaaaactcccagttacagaatatttaagcaccacaagctttgaaaggcaaggaaactaagttccaaatagatttaaataacaaaatgtaagactagataaatacatggagccagtgattgaattaggacaaaggaagactactgataaagtccagcattttttccactaaataatctcactttgcctgtcttatttttagttcttcaggtgctaaatggtattagaaaaagagtattcccacttttcataatctatgaaattataagaagtctatgatccatacaatggaatactgtatagccatttttaaagtattttgttgaagagcactgaattacaagaaattttgttcatgatgtattgatttcaaaaagcaggacgtaaaataatatgctccattttttaataaaatgatacatgcacagaaaataggaaagatgcatgttaaaatgttagcctacctatggatggtgggattattagtgattttcacttaaatctcaattttctaacttatcaggtagtatattgtagttagggaaaaaaaagtcaatctgctgtataattgaaattaatcctttacttcatagttagtatttctcagtagtccccaagctttttggcaccagggaccagttttgtgaagacaatttttccacaggggaggtggattcgggatgaaactgttctacctcagatcatcaagcattagattctcataaggagcatgcaacctagatccctcacatacacagttcacaatagagtttgcatttttatgagaatctaatgacccctaatcagacaggaggtggagcccaggcagtaatgctcccttgcccaccactcacttcctgctgtgcgtcctggttcccgataggctaaggatctgtactggtctgtggccctgggggttggggacccctgacctagacaatctttttattattatttatattgttgaataaagctcttcaaataataggtcactataatattctgagaagtttcatgtgaaagtgagattaaaactcatccacatgagattttttagggcaatattctgtgtaatactatgggagtacatatacacgatcacacatttgtaaaaatccatagaactgtttaacattgagtgaacactaatgcaaatttaaaactcataaagcttcattttctaacttccttatataagccatctgctccagccagatgaatcagttcactctcccctactttgctcttcaggtctctcattcttgaaaactgacacaagtcactacggtcactatgccttcaagaagtcttcaatgggagtctctttccactgaatgcccaaagcctccccactttctgtaccaccatcaatttgacataaaaaatgctgtttattgccttgtgactggttttgtattcttgtcttctgtgaccattcaacttttttattgttcattgatatttaataaaaataagactatataaggccaggtacagtgcctcttgccttataatcccagtactttgggaagccaagacaggaagatcacttgaacccaggagttcaagaccagtctgggcaactagagtgatcccatctctacaaaagtgaaaagaaaaaaaaaatgtagcctagcatgatgtcacacacctgtggtcccagctacttgggaggctgaggtgggaggatggcttaggcccctgaggttgaaattggagtgagctatgatcatgccactgtactccagcagcctgggcaacagaatgagaccctgccaaaagagagagagagagagagagagagagagagagagagagaaaacaaagcaaacaggaaaaaaatcactatctaaaccccatagcacctaacaatgttctaggaattattaaaattattagttcaaactttatattaaaaacataaataaacttaatctgaccttttctgttctggcttcccaaaccttatgagttcattaaaatgtatctttcctctatactcctgaagtctttcgggttctatacatcatgagaaccatacacagatgtcaaaggagcattgccccttccacgtctatgtccatatagcaacagtggtaacttcagaggaaactggggtctcagtatcaatagcctagttggttctgctagtcaaatgtcagttttccttaaattccaacatccactattcctagttccagtcttcaaacattatggttacccttcaatcatacgaactagcttaacgactggctcaaaatcccagctgtattctctgtattttattcctctgattagtatgactcctagatcttcagggaagaggggagacttgcttgttgttatgagcaaaacatacctcaaataataaataaacaaaaaattaaaagactttttttcaacataattgtacctaaatggaaaccatatgagaagagagaggaaattatgaataatcactgtggaagtctttttaaagataactctaagaaaatataaacaaaatatcagtacagtttctttattttggcataacttttgacctagttcagagaaaaataatatttactagacaaaaatataatacttattatttacagagaatttaaaaatgcttcaaaatttgatttaaaagtttttacaaaaatgtgtaagacattcacgtgtaaacacctacaacttaaatgaatttgttaacttaatacttgtaagatcttaatgataataactgcatttgaccacaggctcagagtgtacatatcacaaaacatgccctgtctcacctgcacctccaggaatagggatggccacagatttctgaactctactaatatttagtctttttcattttgtaacttcagtttaaaatttttctatcagtgccattaaaatgtaatgaggattctcagactgtattattctacacttgatagagaagaaattgaattctataatgatgctggtaaagatggtgagtgacaacaattatagctatagtcaataccaattatttgtctacctgacttcctctctgcttcattccaggaaatccctcacacctcatctgagaactgctcccatccactatactgaaatctgtgagagctgcaggttaaagtcccacaaacccttcaccaaaggctgggcataggatccaacctgcattcattcaccaaaatctttcccctggaattttgaatgaaactgaggggaattagtagtaacctcctcactggtggtatagctaggaaaagccaaacagatctgagttcacttgcaccatacagaatgaagaaaactattctccagtagaaaaaaaagaggttgaaataaagaagtaaaaaagtagaggaggagaggaagggcttgatacagtcttcaaaatggcttaagaagggttacttttacttgtactttcgacttaaagagccccgattgccacaatagctgccctgtcttaaggcttacactgtgccagaaactgggcttaacacctcatgtgcattaactccctcaatccttataactattctattagcaatgtattgttactcacataattaaagaaaataaaactgaggctcagagagagtaatttactcagagttacacctttagctaaccacctaactagaattagtctgcctgccctcaaagttcaaactccttttcattgcagaatatatttccaacctaccttccaaacatatgcctttcaccagcatcataatagtagtgaatttggcaatagaacccaatagtttattggacctctaacatatgaaaaaaaatcatcatcttttagaggttacatatgtgatcctgaactcttgccaatgagtgcataaggccaccaactctatattctaatacttaaactaagttgttataataataaagtttgaggaatgagcaaaataaattatagtagtatttgaaattaaattcaagattctctcatttgttagataatatgccattgaaccaagaagctcaataagttctgatttctagaaaatacacatcaagtcaatgtagcatgcatttattggagcccttctttatgttctgctgtgcactagacactaatataccaaatcaacaataacaaaaatatatctctcccctatagaagccacttggaggaacaggacacacaaatgttaaacatcttagtgttatgcttttcttaaaattacaaatcataaaatcacatcttacgttcagatgatgggaaaatttgtagagtcggagatacctaaagtcctgtgtctgatgtaatggaatctttaaggataaataggaagttatacagtcaaggaggagatgcaagaatactgcatctgatactcttatttcatttattaggtacttaaggagccagtacaaaagttgttgtagagagccatgggtgaagtgctgcaatgagaatgtagcagataggaaagaaaaaagaaacattccaaacaaaatatatacaaagaacacatcattaatttaacataggagataaaggaatagatataatcaattatgacattcaatttaaaggtttagggcctggagaaaaggatgaggtaacaaatgacttgatttcttattcagttcacagtttcttccttgtaaataacagagtatgttaataaatcacttcagacacctcatacctgtcaaaattaccaaaacagtgaaagataacaaaggttagtgaggatggaaagagaagagaacccttgcatactgttagtagaaatgtaaattagtacaaccgttatagaaaagagtttggagggtcctcaataattaaaaatagaatatgatccagcaatccatcttctagatatatattccaaggatatgaaatcagtatgtctgagatatttgcactcccatgttcacagcaacattattcgcaagagccaaaatatagagtcaatctaggtgcccatcgacaaatgaatggataaagaaaatgcagtatacacatacactctggaatactattcagcctttaaaaagaagaaaatctggtcattagcatcaacatagatgaacctggaagacactacgttaagtgaaatgatccaggcccaagaagacaaataccacatgatctcacttgcatgcagaatcaaaaagagtggaattcactggactagagagtagaatgcaggttaccagaggctgctggtttggctggtggtggggggaagcaaaggttgaagaaatgttgataaaagaatacaaaatctcagttagataggaagaataaattcaagagatctattgtgcaacatagtgactacagttattaatatattgtattctttaaaaatgctgagtgtggatgtgaagtatccttaccacaaaaaaagataactatatgagataatacatatgttaattatgtagatttagccaatccacaatgcaatacatgcatcaaaacatcatgttgtacagcataaatacataaaatttttacttgtcaattaaaaaataaaacgaaataagtcaatcacttgagaaagaaaggataacaggacaaagagactggatgtcttatatattttcttgaaaattcaatgagataagaaatgagaaaaaaataagaatttgggggaagtttcctcataatccagctcttctccctgttttccccttctcagtaaatggcagcgctccttacctagtttcttaggtcaaaaatttaagagtgatctttgactcttctctttctcttttcctcaatattcagtccatcaggagtcatgtcacttctgtcttcaacatatatttatccacatctttactcctccatcactgccatcctaatctaagccatcatcatgtgttacccaaaaaactgccatagcaatgtcttaacagttagtgtctctatttccactcttatctcttcctcatcaccaccaccaatagtcaattctccacacatcataaatcagattaaaatataagtcaggctctgtccatgtctcgtttaaaatcttccaatggccaagataaaacctaatctttatcataagattggttgacaaagtaaccatttaatttcaaagatcacatggctacccttcaaagactcacagcaaaagatatacataacatttgtaatgggtaaaagcaattttttgtgtctaaatctaacttgtcttgatttatttacaatccaaataaaacctcaacagttttgttcatcagtcttcacaagtcaactcaagcaagcaacaacagagagtaatttagagataaattgataaaacacagaataaaagaaaataatttttcttcaaaatatcttgctaagcttactttggttgattgtgtaagatacaagcttataaagttaacatgaaacttttcctccgaagttttcacactaccattattcacatatatatatatatatattttcaggtatcaaattcttttggtgaaaattcatgaaacagttcatctgaaatatgcttatatcacaatatattagaaagacaaagacttattgaattgacttttaagattgtagagccatgtttaaaaaggtggcctaaataaggtctgtagctcagttaataccgtaccaatatcaacttgccagatttgctaatgttctatagttatgtaatatgctatcatcagggaacactgagtgaagggtatatgtaaactactatttttgcaacttattttgagtctgaagttatttttaacattttaaaaaaggttttaaagagaaagaattccataaaatgaatatactacattaattgcacatcatttgtataaactcattaaattatttctcctcaggactgatactaagaaactttgtttttaatatttgtaatatgtagaacacacgcaatggaatcagacaaatcagggtgaaaaatccagcctcaggaatttctagctttatgaacttggaacatttacttaacttctccagcctcagttttcatatccataaaatgcagataataatacctaacttatagcattgaaagatttaaatgagataatgtatgtaaaatgcttagtagaggcctgacatataacaagcttacatgataagaaccaaataaatggtagctagttaatgactatggatagttttaattaataaaattgagttcctttcaaaatagcctgtagctcagactccaaatgaggtttttaacacattcttataagaaaaatccattcatatggttcctgccaaattccagcttgctaaccttttaattataattaaagtttcttattgatccttgttagaaatgcttacttcacaaatccttttgaatatcagaaaagcactttaaattcaacatgacctaatctgaattcataatcttttctctaaacttagtcctcctcaagtgaatgacaccactatccagctacacaaaccagaaaccaagaatgcacttcatattcaatgtgtcttatagggtttatctcctgcctttaaatctgcccacttctccattgctcctgcagcccctgactacaattacactgtctcttgctgggtgtctctggatctactatcaagctctcctgctgtctacattctgcctacaatattttagatgtacaagtatgataataagtgttacctcctatccatactacccccttaaaaacctacaacagcttcacaatgctcttagggtaaaaactaaaattcttttttttttttttattatactttaagttttagggtacatgtgcacattgtgcaggttagttacatatgtatacatgtgccatgctggtgcgctgcacccactaactcatcatctagcattaggtatatctcccaatgctatccctcccccctccccccaccccaccacagtccccagagtgtgatattccccttcctgtgtccacgtgtactcatctgacagagggctaatatccagaatctacaataaactcaaacaaatttacaagaaaaaaataaacaacccaatcaaaaagtgggcgaaagacatgaacagacacttctcaaaagaagacatttatgcagccaaaaaacacatgaaaaaatgctcatcatcaccagccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaaaattcttgatattgccaatgtatgtggccctgacacttaaccaactccttggaaccctgtcatgatcagcccctactctccacatcaaccatcatggtattctttcagaccctcatgttctccattctccctcccaaccacagaatcacgtctccaccctctgcttctcaatcacctgtgttgactcctcaatatctaaaaagttagaatgcccccaatctcaatcccatgctccaaatctctcttctacccatgtcttcttcaataatgacatcacctacttccaagatggctgcttccaagccctaaattatgcatctgattttcttcttggcatctactcttggtgtctccaacttcgcatgcccctgctgccttccaccctgacaaacctattcccctctcagtcttcccaactcagtgcgtgcttcctccattcatcagtgtgctccatcaaaacacctgcagcactctttccttgcctccacatgcagtcatcaggaggaccagttgttctctccatctccactgcctcttccagagtcccagatacatgatttctggcctcaactggcctcctaactgatatcccagctctactgttatctccacaatccatcatctacacagccagagaagttttttaaacaaaaatcagattccaccatcctcctgcataaaacccttcagtgatttcccctttgacctcttatacctgaacaaggtcctgtatgacttggcacttgccatatcagacaatgctgccctctgctcactctgcgccagctatagtgaccttcttcctgtttcccccctacccccaccctaggccagctggttcccacccatccttcaggtataagctcaaatttctcatcctcaaagagactttccctgtccattcaatctaaaatggtacccttcacattttctgccccagctatttttgatcatatcaccatattgacttccttaccagcatattttataatctcaaccacgtcatttatatttctgtatttgtttgagtatcgtctttctctcaactaagatctgagctcccagagggcagcaatctcttctaatttgcaatctcttctatatgtctagtgcttacagtctgacctggcacatagtaaatattcctcagatatttgcttaataattgaatgctgtttgctctggctagaacaccgtttccacatataacccactttgcttaattaatgtccatgcttctttcagatcccacctctgaaattatgcttcagggaagccttctccaacttcccataaatgcctcaagttgacatattcatgttttcagaatcctacataacccgccccttcacagaatttatcatgtatgtaattttacatttactatttgattaacgtttgagtttttacttaatattatatctccagatcatagctcaatgtttgacaaacataagcatttgtgaaaatcatgtcaaataaataattttaaataaccatgaacataatacctactctacaaagaaattctgtacatagagaaaagcacaccaaagcatacctatcaagatagctacctatcatttcaccaacagggatccttgctgtgctgtatgtccttccagggatttccctattatgtatatgcatacatatttttatttctttatctacaaaactaggctagtatgtaagattaattcccatgtgaatgtgagcctctgctctattttgtcaacttggaattcactattttccatctttgccaaattaaaatttaaaaatggtattccattactgttttaattaatattcaattctagtaaagatgaccattttttctatatgtttattagcaagatgtattttttttgtggcttacatattcaaaccctttcacaaatatgtttctggtgtattcatatttttattttcattcttgacatataaaaaatattagtccttcatctgtactattgtatgctgcaaatattttctttttttttaattttgttattattatactttaagttttagggtacatgtgcacagggagggatagcattaggaaatatacctaatgctaaatgacgagttaatgggtgcaaacattttctagttgatcatttgtcatcacattttgtaactgacatgcagaaatattgaccttgttatattgtcaaatctattatttactgctgtggctattgttttgcttgttatgatcagagcagtctttactgctttaaattacatgtttacttaaattttcttcaaataattttatggttttaacttttttacattttgttttctaatccacctataatttagagtaaaacataaagtgggaatctaattttatatttttctaaaggatttactaattattccagcctgtcttcaactaaattcaaatgctaatttattcaaattctaaaaataatgcatgactgtgtttatttcttggtattctttttagttttggtgccaacaacagattactcatattagaggcatacatttaaaaaaaaatgctaatgtttggctattttctcttttttttggccttttattatatttagttacatttgatttatcatattttggtgtccctcagtatgttcctcttattcttttcttttattttattattattatacttcaagttttagggtacatgtgcacaacgtgcaggtttgttacatatgtatacatgtgccatgttggtatgctgcacccattaactcgtcatttagctatccctccccgctcccctcaccccacaacagtccccagagtgtgatgttccccttcctgtgtccatgtgttctcattgttcaattcccacctatgagtgagaacatgcagtgtttggttttgtgtccttgtgatagtttgatgagaatgatggtttccagtttcatccatgtccctacaaaggacatgaactcatcattttttatggcagcatagtattccatggtgtatatgtgccacgttttcttaatccagactatcgttgttggacatttaggttggttccaagtctttgctattgtgaatagtgccgcaattaacatatgtgtgcatgtgtctttatagcagcatgatttataatcctttgattatatacccagtaatgggatggctggatcaaatggtatttctagttctagatccccaaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtcagttcatatgcttcacctactttttgagggggttgttttttttttcttgaaaatttgtttgagttcattgtagattctggatattagccctttgtcagatgagtaatgtttggctattttcaagtgtttattattccaaagaatttaatgagtcagattctgatgcatacattagacctgtgattcaagttgtattagatttgacatctttaaaatagtgaaccatcaaatttttgttatgcatcaccatttattctgaactctttttatgccattgaatagtgttttatagttttgtttttataggttctgtaatttttcctaaatttacttctagatatttgcagttgaaattttaaataagcttgtacattataatttaaaagtttactacttgtatattaaaaagatgttgatgtgcatttattgaaggcaactgagagtttttcagataattctctagttttataggatgaaatatccattttataaaccacataaaaagatagtttggattattttcaataattggatctaatgtatttttcttgcctgaatatattggctaaaactttaataataatatttaatgattgttgtaacaaacgataatatttaatgtcggtttttctcctaaaatacaaaactgtttgagaggaatcctttaatgtttattttgtattattacttaaaccagtgcttctcaactaatggttataccatccaaataaatagcattaatttaaaagaagtatccttgtagtcttcatttactgtttattccaagaatgtttgctgaattttattaaacatatttcctttttgtgccaaattggtcatgttcttaatcttcacatctggtattaaggtaaattatatgaatggattatttcatttcaaattatctttgttcacttgaatgaaacacattcaaacatagcttgctttgtttgttgcttttttatttatgattttttacattctatttggatgttttctcagttttcttttttgagttattttagtagctataaacaagtgtaaagattattttaggcctgttcccttaaattaactgggaatagattatataacataggaattatttgatattcaactgattggaagaacatggtataaatttatgtgagccaaatgtatttttggagataaatctttgataaatttatatctttcactattccttgttctttgttttattcttctctagccaattatgataattctaaattatcgttaaaaattcctttttataaagtatttttctcagaaatgttaaagttgcactatatagatttatattttttacattataactctaaactattctgtacttacatttgaactgtcatttctcattttatatattggggttttcttggtatgattaaagttattagagattaaaccactacctctttttaaaaatttaatcttactaattttctactttctatttcaccaatttctgcctttttcttgcattgattgagttcattagacttatgggttattttgtttctaatttctcatattgacagttaatcttctttgtttagaagaattttttgtttagaataactgtcaatatgaaaactgtcaataagaaaagtttgtttgcttattcaatcatgaaagtatttaatgtgatgacatgttctataatatctcgtacgctatattctcattattgttacttcccagctattctgttggtaaagttttgatattttcttggatataaaagttatttagaagataatttattataccttttttcttgtaagaaattaagattgttggtttatattttattttaatctccatgtttattatattgtgatcacatattattattaaaatttattaaggtaattatggatatatattttttagggtaaaggagtagtttgatacataaattaaattgcttttattatattattcatgttcttcttgttttctttaccttttttaacctaattaaaagatttggaactgaaagagataaatacgtgtcttagatcgtgatttttgtttctgtcaatttcaccttacatttcctagagatttgctttatatttctatattgtattatctgctgtaaaacttttctgactgttagtgttttgctatgattgaaggctttactaatgtaaattataattatttaaccaatttgaaacatttattttgatttttacctgttttgttaataattttgaggctcctttattttgttttagatgtcaatgatttattcttatccaatatttaactttaaatttctcctagttggttttaagttttcctctggtaaaaaagttataattatattttgacttttaacccaatttttctatatagcattatttttaacaaatattttgtttctgtaactggcaaatttgtacttactttcttatttctgtttgttttaaatataccttttttgttgcttttattcttttaccatttcattttctttttttttctattttattatttattttatggtttctttcatttttttcccactggtgatttggaaagtatatatgctattcaaaattctagtaaaacaaattaactcatatttacctcctatggctatagttccagatttttatctgataattttgaatggtgaagattcatttatgtgtcatatttgctaagctattatacacagttactcaatcaaacactaatctaggtgttactgtgaaggtattttgtcaatgtggttaacacagttgagtttaaggagattaggccacccaataatgtgggtgggcctcatcaatcagccagaagaccttaaaagcaaaagtgagatttctttggggaagaagaaattctgccttaagacggcaaaccagttcttccgtactttacaacatactggcctgcttacagatttcaaactctccagctcccataattgtgtaaatctatcccttgaaatacatctctttatatataaatgtatgtatattaatatttactatacctattgtataatttacatacatataacaggtaggatacacacacacacacacacacacacatgcacataacctactgattatgtattttttgtataaagagaactccaactaatacattaacttttcaagtgttatgtcatttcttttacaagaacaattattagaatttgttttaggccaggcacggtggctcatgcctgtaatcccaggcctttgggaggccaagacgggtggatcacctgaggtcaggagttcaacaccagcctgactgacatggtgaaacatctctactaaaagtacaaaaattagctgggcatggtggtgtgtgcctgtaatcccagctacttgggaggctgagacaggaaaatcacttgaacccaggaggtggagatcgcaatgagccaagattgtgccattgcaatccatcctggccaatagagtgagactgtgtcaaaaaaaaaaaaaggaatttgttttgttttaataaccatagttacactataatatttaaattatttcagtgcttcttagttatttatattattctcaaattttatttctgttcccaaattttaagtttagtttaatctctttatttgaacactgaattttcttccattttccacatgagcgtcttagcagtgtgtccaattctttggtcacaatatttttttccttaaacatttatagatgtggcatcacgatcttcccacatgtgatggtgtagaggtgaatgctaaggctagaaagcttgatgttcctttcctttactttttgttcactctatttttcttatactatgaagataatgtaataaagcaatcaccatccttgatattaatcttttctaataaaatgtaactattcccatattttctatgtgtatttcagttatagtgttcattattctttctgttgtagttattctgagttcttactaaaaagacatatgacccatagatagcttttaattttctgatctctatttctagtactttatcttttgttatttttatttcctagtcttatcctctgtgtttggataggtctccatcagtttgttcttcattttacctattctttgaggaagcaatgactctgttctttactgcctccaatgcattattaaatttcacaatatacttcatatgtttcatctccctcctattttatttctgtctatatcttaatgaggtaccttttcagcttagacatagtattcttacctcatacttcatctcttatctcatggaattcatatattttaagattttatggacagcaataattatgtattatctaaaattttctcctgaaataaactgtgttcctctattaccttttgcatgttttgttctccttctgttatgttatagagatattttttaaattccctataatcgcttatttttctacttgctcatcctttaattataatgtttaacctaaaaatcagtttcatattgtaacaaaatctcaagcagaagcaacctaaacaacaaccaagaaaaagccctaagttactctcattccttacctctcatttcctgaggcaatatcagctccaagatgtgtccaggagttcttaggataagcactgtaaagatgaactttcccataaacccctgaaaataaaaggagtaacagttggatagaaaaatccttcagaggaatgaaagccaggtaagtaaaagtcattccagaggctgttgtgcaaaacatgtgatatagaatctctatatgaaggtcccatattatcaaaagcattatttaaatgctctattttacaatactaagatatatctcacatggctatgaaatttattctctcaaatgctatagaaaaaagaatgctacaccacatcacaataatctaaaaggtgggaaaatagaccactctaatgactaaagttgaagaggtactcctttccactcttacgtgactccaaaccatttgcaattcttttggaagttaaccagttttgatattttttgttacacactaggttctccaaaagcatggttaactctatttccttaggatagagttttggagctattagctttatgtttagtggctggacttaatattttgtcttataaatatcaagggagagatttctaagtcctttgtttcaaaatgcagtttatttcagactaataaattaaaggcttaggagaaatgtgcttgatacagctcagttttattttttcatgtctttcttcctatatgttttattgccattttcaatcataattcctcatattctagtggtttaaaatgttttgaccatgaacctcaccagaaaaagaaaaaacatgtgattgtgtactctcagcacatatatatttattttatttagataactcagatatttatatttagataaaaaatatacacatatatgaatatactaatatatattggaatagaagttctaatattttattcctgcacccaaatgtattgtctgcatatccctggattgatgcactgtattttattgcaagtcattaatctaaaaatttaaaaattttacaattttcatcagaaaacatagaaataaaagaagcaggagaccactaaggtacaaataatatgactttggtgttcatctgataaggaccaaaaaaaaaataatcccaattaattagaacttaaccaactgtttatatcaacatccacattttttccatatatcaactatgaaaatgtcagaagataagaaaactaaatcaggataaatggatataaaaagaaccccattttcaggacgtgtcctgaaaccaatctttcataatagcatttatatatttcataagacatcatcatctaaaaccaaaatccatcttttttcactataggctaagtaagctaggctgagaaggatcctgaagtaatttaaagagattttcaaccaaagcatttataacaaaaagcagttcatgtccttaaatttgaattatccagaaaattcaattgaccagaaaagcagatttcttggtcatttccaatcatcaaaggtttactgtaaaatgacaccatttcttagttgtttcaagaagattacaaatgatttaatacgattaaaatttgtcatctacttatgatactacaaaaatttgagcatgcagtaaaagaaatacttcattctttatttcaatttagtatcaaagaaaatttcaaagacactagtttgaccgtacagccaggatcggggatcagagcaggcatctgtggatagtcctaacagaaagtttgttccagtgttatcacgctacagaaaagagtgaataccacaggcaaaagaagatcaaatattcttataataatccatctagtttgtcaacttagaaaaattaaaacattcttgaacctcttgttattagaaagataaaataaatagcatgcatggaaaaaacctttggaaacttaaagtgctatcaaagtgttatatgacaatagttatatattatggaactaagttaagaaacttcatactagcttaacattattgcctccactctattgagtactgagatccagagagggagccattgactgctaatgaatattaaatttatatctcatagtgttcagaaacctcagaaatgatggtccttgctctttttccacaaggaaaaatgacttacttgaaaacctccaacacagcaatgcatctaagggagaatccaagaaaattaacaaccaattttctttaaaaatgttcatattttttcttttagttaatttttttctcacttatataatagttgaaataagttcactatattttattattcttttagatattgtattgtcacatagcttaaatatgataacatatttattattcttttagctattgtattgtcacacagcttaaatataataacatatttttaaatataataacatttaagctgtgtgacaatacaatagctaaaagagtaataaagtatagtgaacttatttcaactattatataagtaagggaaaaataaccaaaaaaatgaacattcttgaagaaaattgcttcatgccaagagttatccctctttacttataaaattagtaatgcccatatagaaaaagtgagaaaatactttaaatctgatgaacattctcttatgcctcaaaactgagttagttggggatacatacatatggttatacaaggccagtccccgtttctgtacttttacatagaccaatttaaaatagcatttggtattgtggcaatagcaaataaagaaattgtcaacagtgaatgttccttattaatttatagatctatcagttgtataaatgtatcaataatcgagtagtatttatagttgataatattgactcagtcgaaactttagtgtctgactaatctggatcttaatccataatgctgacactataaagctgtgtggttttctgcatgtcgttcatcatctctgagtcttagttttgacatctctaaaatggacactactcacaagagagctggtaagtgaaataataaatataaattgcctaaaagggtgtttggaatttagcatatgttctatgaatagtatttctctatcagacacaagcacacaatacacacacatgcattttatttttaataaaaactatattatactcttaccaattgttcctgggtcaatatgaattccattcatacggtcacaaaagactccctctgaggctctaaggagaatcagaagcttttgttccttttctaagggattttctaaagtacctgtttacaaagaaaagtatatcattcaaatcaatttgaaattaaaagaaagagagggagaaattgcagtataatttcaataatgcaatgtagatactgtgaagtagactatatggaggagtcaatggtcatgcagatgaaataagagtaggataaaaaagattcagtaaacttctttgaaggagactcatgtattattcaccaggtattcactcttctttctttattagggcagtgtaaactttcctgacctactaatatttatcctggtcatatgacttgctttgaccaatgaaatttgtgtgaaagtggtaggaatattagttttcagttgatgctttaagggacttggcaagttgttttgttttgttttatttcattttttaccagatctctttcaatgttgttctctaccatgaatacagaatttcttaaatagcctgtggtatctgaatgaagagatatgcagagcaaacctgaatagaatgcacaagctggagccaagttcaactaagtctaacacaaatatttcttgatgtaaaccactgagatttggggattgttacacaccattattatggcaaaacctgcctgatacactgtctatggctagataaccttcaaatctctttatatgcattttagcatttactcctcacaacaaacctgagaagtcagtataattattatcccagttttaaatatttgcacataaagaggcttacaggttaagggacttgtctaaattgatccaactattaagtaacagaatctatttgaacacagatctgtttatgctaagtgtttatttaacagataagaggttattttctaaaactaaattcttttagcagcataaagactcataaagacataaggctatgatactcagacagcagttggaattctttctgacctaattttattgatgttaacagtggagtttggtatgaaaattcatacttctatggtatgagaattgttcagggaatttgtcaaattagcgttagtgagtatggacctgaggaaggttagtttcaatggaacatatgtcttagagtacaaaaatactaaagttattaaagtcagttgtttgagaagtaactggtgggaaggtaatcccaaaattatattccaaatcagacaggttaataaaaaccaccggctatcaaatgcgacttcccagtatataaattcccgaaaagataaccaaaaatgacattgctaaatacaatgtgaaataactagtaaacttacaattgcctggttttcatcttggttgctggtcttttgagcaacataaaatcatccccccttgctgacacttcctatatacctggatagccaaaaggcacaaggtaagtctaaagcttgctacatacctatttttatagttcagccttcacagccattactctagtactctgctgaaagcaagcaagattcagacaggtaagtaaatctgcctagaggcatatagtaggtcaatgggtgagcaagcctatgtatttccaataatatgcaaaggtgtgttgctcctctgtgtaggtaatgccactcctcagctgagagcctgatgcatcatcttagtgaaaataaagatgtgctagagcagaaagaagggaagcaggggaggatgaaaatgtttagtaaatgtgtatggcgtagctgttatcttgccattacaagtctgtccagtaagctgttttccaactgtgatttcatttatttcacggagggtagtttagagtctttgggaaaaaaaaaaaaaaaaaaaaaaaaaaaaaaaaaagtggcctagcactaaagagataccagagagaaaaaagtaggacagtttttgccctagagaaatgtatgcagagtcccacaaaaagagttcagcgttcctctaaaattagagattaaatcaattatgcaacccaacactgcagcacatgtggagctttcgcagaaagtctgggcaaaattagttagcctgccgtgatattttgctatctgcaatggccagaatttggcttcctttttgtaactgagagaaaacgaaagatgaagaatagggactaagtacaaagaaggcaaaggtgacctaagagaaggaaatacatgctattgcaacataaaaatgaaatgcttcttgaatgtgtaaaagctgataaatggaaagctttaaaggctgagatcctcattttcttctcaatctagcaatcaaagaaaggtgaggtgctctctccagcgtggactttgcccctaaatgagggtagccacctctgagacagaagatgctcaggatacgcagctcatccttggtttacctttgtaaagcttctctaaactatactaagaggcatattaaacctgggcaaatttatgtattcataatgggaggaaaaataattgtcattgtgctgcaaagacattccggatattttcacatgcacaatttaattctcacaattttatgatgaatacagttgaggttctgatgaggaaactgaggcaaagagaggttaagtagcttgtcaggaatcacacagctgttaaatggcgaagttgggccttagacttaataagtaccatcctaggacgtgtggatatggaggaatagaaaagaagtaaagggaagcaggcattacttagtatgatggtgggcagtgaaggggaaacaatgtgttccagatgctaaaatcacctggagagatggtagaaaatgagttctggcatatgaaagataatcattataattatttggggaatatggtacaaatgggttccaggaacttcaaaaggtaagaataagaaaaaaaggcatttcattattttattaactaaagctctttgatggaatcaagtataatcctagtttgcacttaagcccactctgtcaacatgactcaccagaccttgtaccaagccaacccgtaagaaattatttacccttccttcaactcactctcctctgtgctcatgagatttcccagcatttatgttttaccttcatcttaactaactctgattcatccctcaaaacttggctccaccgtaatttattcctaaaagccttctatgatcttgaattagatgtccccttttgtgtgtaaaatcttctgtaccccttgctaaagtaattctacttcaagaaacttgtcctcaagaactagtaggggacaaggacaaagaataatgctcaaagttctccactgcagtgttatttatttataattggcaacatttaaaaacaccttgaaatagcaaacaattagaaatatttttgtccattttaaactccttcctttcttcccagactttttgacacacttaatagctgaaacatacaagtccccaagcaaccatatactcccttgcctctgcccccctctgccttcattcctgtttttgtcacggccaactcttacatactttcaaacccagttcagatgccacctcttctggaaatgcccttgtcaactaagtctgggttaagtgaccttctaagggctatcacagaatgccatgttttgctacaatacttctaaaactatactgtaagggccatttacctgattgcctccttctctcagtgagcgcaagaagaaactatgtattcccagcagagtttatttgaagatattttattccagaaatgtttaacttggtaatttttaccaaccctcctggagaaaacaattggaataaagaaaaataccccctagtaataaaagactaatttcaccagtaaattacaacttttaagcatttatgtacctaccattatagcttaaaaatatatactgcaaaaatcaacagaactacaaggacaaatggatatacctataatacttgtagtaaagccaacacaactgttgctaaaaaaaaaaatacaataatgatacagcagttttgaataatgcaatttgcatatttgacataacaggcatagatggaaaactagacccacaaagaatgcgcattcttttaaaccttgcacaagacatttaaaaaaactgatcatatgatgatgataaagcagtttaacaaatttttaaaaattggaattatacagcatttgttttctgactatagttccatcaaaatttacaattcataataaaaaaatttcaaaagtgagctatattaaagatctttccaattatcaaagaataccattaagaaagtaaaaaagcagccagatgtggtggctcattcctgtaatcccagcactctgggaggccgaggcaggcagatcacaaggtcaagagatctagaccattctggccaacatggtgaaaccttgtctctactaaaaatacaaaaattagcttggcgtggtgcgacgcacctgtagtctcagctactcaagaggctgaggcaggagaatagcttgaatcccagttgcggaggttgcagtgagccgagatcgcaccacactgcactccagcctggtgacagagaaagactccatctcaaagaaaaaaaaaaaagaaagtaaaaaagcaagccacagagtgggaaaagacatttgtactacttataaccaacacaagatacattccaaaatatataaatgactttgataaatcaatataaaacaggtacattcatcattaaaaaagagtaagagaacagctatttcacaaaacaagatactctcaaataaataataaatacattctactatgctcaatcatatcataaaaaagaaataaaaattaaaacaagaatgagatctcactacatatccagtagactggatttataatgtttaattaagcatatatttttcattttataaaatttgttgtatatgtgtgtcattttccacaattaataaaaatatgttaaatgactatgttccgagaatactcttcaatgagttttgttgatcaaaagaggggaaactggccaaaattttagtcacatcttctgaatatactattttccaggtgctagtcactgaatccaaagcaacaaattgtatttttatataatttgtatttttatctgagttaatcttaaaactctataaatatcacgactgcacatgaaagataaagaaattacccccaaaataaatttcgtacatttttcccttgtcctcagaagtgggttaaatggtgtttactttggaagttgagcttctacccaaagcataaccatttttctcatgccctgcaatagcaattttctgaagaccagagcctctagaaccttcttactatcatataaacccaagctggtaaatagcactcaaccaagtaaattgcagcacatatttttttctgaattagcttttaattcccagtgtatatttgactcgcttattcctaaaacattcctctccagtagaactgattccatctgaaaataaatgtagggtagaatggggcttgcagtccagtaagataaaaattggttataaaaatcagtaggcattatcaaattataatgtccaacccctcataaagtgattttattcaggctaacaaattttcatttttaatgaggcctctcaatttttcaattaatggaatattaaaataaacatgaaaatatgttattcattcactacttgcaaaatgtacaaaaattctgaaaacttcctccataaggtcgagcaaattacctcatttctttaagcctcagcttcctcaatgataaaataggcacaataatagcatccattttttgtgaggttaaatgatttagtccatgctaatagtatatggcacagtgtctgtacataatacatgtttttaaaaaatgttggctcttagcaatattaataatagtagttaaaaaaacagtaatagtaaccatggaggtatcacacttatttaaaattaacctttaaatttgaaaacttaaaaaaataaggcaagctcttcctagcaagtaatatctaattcctaaagtactagctagacactagacatttcaaagcaaaaatattaagtgactacttatttcaatggccagcccaaggaacttcagaaaacacaaagtttaccttaaactgaaacattcctgtaagttttctaactaaaaaaaaaaatcattcattcatttattcactagctttcctaaaattattttgtttgtatgcaaaattaaatagtttataataaatttatatgattaattattttaataactaaataaatccttaagaaatattatattactgttatatggattcatgaatcaaaagtacagtttaagaaagactgatttaaaaattattaaaataggaaagatgattactgcaaatgcctttagtaaagactaactgatgtcccaataggacagaagaatatttatttgtattagtgtttggcttaaaaaatatattaaaactacacacacacatatagatttaaggataatgtgatgttgtgagagaactaatatccatcagaaaataaacagatctttctattcttaatatcattttgaaataagtattatttaactgttggctgccagccttattagggactctccaagcacagaaatgagttttagtgtttcctgaacctctaaggggcaaaggttttacacttttgctcctggttaaatggagcaaatggttaaatggttaaataagtaacagcttcaaaagtcacatcccttttatgtcacctttttattttatcaaacaaccgttagtttgattagggaactgtgcatctaaataaactgaactaaccatctattttgcaggtatctatgtacacttatattatacacattgcatatgtgggtatttgtgtcattttctaatcatagttaaatctgaaggaggacatacttttttaactttgtatatttttttaaatgaacatcacatacaagattctctctggctgctcaatgggtctgactactgggtattgtggctttaagctggaggatatgttttaatctacgcttttctcaggtttgtctccttcttattacttaatcatccaatgagccttacagaactgtcagtttgaaaggcaataaactgtgtatggatttttcttcttctttaggattgagaaagtcccaatcatggaagcaatgaaagaaacttccatatacctagtacttcgtttcctgacaatcaaaggcacgtgctaatgatgaccttaggcttctggctacaaatgtgagacagggctgacaaatacccatcactgaccctgaaaaacaatatgtgacaagttttaggataaaagcccgagtgcctaggataattactgagcaactagacagtgcatcatgtgacctggttgtgacaggccaaagaaacaatgaactgctgtgtccccagggataccaatggttggggcatatcttgttgactagggatcaaggaggtttctattaaactttaaatatccattaggatatgtgtttcaaaaatgtatttttacaatacaaataaattttataaaattatataaatttattattttataatatttaaatactatatttattttatattattttaataattaatacaaatgtattattggtaacccctatctgaagtccttctaaaaatattaaaagaagatttttcatttgcagttttaaaagtacaatattaaaacagtctttattgagttgactgtttgggtcaataacaagttaacagcattgatatctaaaacaacaaggaacatatttgttaaagcatgagaacaatgtctcatataagaggagacattgatgaaagggatgggctcagacagctattcatgggcaaagcttttatatgtttaaaaaaacatttaaatcaaataacaaacaaatgtttattgaacaagctttgagtgggggacatttttaagtcagtttcctgttctaacagattgtaaaaatgaaaatactttgaatcctacaacacatcaactttttaaatttgtttttgtaactccttttttcctttcacataggggataaatatattgtagtcatttaaacattaacaccataatttcttcctcacagatgtagacatttaagtgtaaggagattgaatgttttccaagaaaaaggcagtgagctgaaagacaaacctaaacatgcccattcacttatatatacattgtcagtcataacagcatattatcagaattctataatgcagtaggtactagggttataaaatgttctgattaagtctatcatataatggagataggacactaattaaaacatgctattcatatcattaccgaatgcagtaatggcaacatgaatgagtagcacggatcagaaggaaaggtaactgaaatctactgcatggagacaggagaggcttcatataggttggtgcaaaagtaattgtggtttttgccattaaataataaaggtagtccttgggcaaaggcttgaaggatgatatttaagatagctaaaacagccatttgtcctggtcctgttttttgtcagctctgagaccttgaaacaaatcaattatctctctggatttcagtttccttaccaataaaacgagacagacgtttcaaacaatcacagagatttgcaacatcacagttatgaatcttctattggggaattttccagaaattgtacaatgagttactaaactaaaatcacaattcatgtctctggaatttccatatttatgaagctaatttctgtcttgttaaagccatactcaagagactatcaataagtagcaattctcagcataatttggactcatttagaaagcaacactgtatatctcaaaatctagcccatgaaactcatgacgttcactataaactcactactattcactattctttagctacaggggctgcctttctgcctcacgactaccacacaaagcacatttctccctcgggacctttgcactagctctccctcagcctgaaatgctattgttcaagtcttcgcaggtctagctttttcttgtctctatagtctgatgtcacattgacttgttagaaaggtctttactatctaacatatggttgccagcatccaacctggacctctcattaattacttttcctatttaatttctttcagagaatgtattaccatctaaacttatcttcctcatttattttactatttaattgtctgtttcccccaataaaataatgcaagcaggaattgttcactactgaatgtcttgttcactgtggaatattcaaatgacagaaagaatgcctgaaactgagttggcattcaatgaaagagggaggtgggaggaggtaaaggaggaagggacaaatctacaaaggaaactttggaaaatcaccatatcagaggaattattttctccttagtatcgatctattcatttcatttcaccatccaaaagaaaaccagttattcatgaaagcaatcctataaaggtttgatgccatgactcaatatggacaactattcattttcaaccatgaaattcaatatgttcaatgacacctcaggctatatactaaagccaaaaaatgaagttgttaaagaatagataaatggtattgagtttatgaaaagttattgctcctgaagcagtaagtgttgcatttttatttgttttacatgaaaagtaataatttgtgtcaaaactgtatttatcagccattataaaaaacaaaaagctggaataagatggccaattttcttttctattttctttgccatttccactgtatctcatattactgactacttcctcttgtaaattgcctcttttgtttcaagatattattttcctgtcatttcattttctttccacctatataactgtttctttttcattcttttcctgaactcagcttcctctaccacccttcaaagacttgcgctcctcaaaatttctatccacaaaatctgtttggccagttttattcacacttttaatttcacatttgagctgatgatcctcaaatatgtacatttagcgcagacctctctcactggtttctttattcataaatctgcttgttctctagatattatcacttagatctttcactgaaatctaactttgaaatttatgagtctgggtacttaacaaaccaatgtataaagtttactgtatactcaacattgttcaagcattttaataaacattaactaatttacttttttaaaaactctatgaaatacgtactattattatttctactttggagataagagtactgagacacagctagttcatataacttgccgagggccattcaactaatgagggatggaaagggcactcattcctggcatccccattggcccagatctcccaacccgaaaccctggatatatcccaaataactcttccttgcctcagatcaaaattctcactaggttctagtgatttttacctcctcaatgcttctctaattaattctttactctttaactcctgtaccttacttcactccctgacgatttctttcctgaaacatctcagtaggcttctcacttttcactgtgtcccttttaagtgcattctctacacttccagcactaatttttctaagaataaatataatcatgtcacttccttgcttaaaactatccagtgactacccactgccttcataggaaaatccaaactccttggcatagtatatcaggtcaaggtgcttcatctactaccaccatttcatacaaagcctacaatccagacatacccatcccctacagtttcctaaaagtataatgctcatctaaaatatgtacctgttcacatctcttcctttatctttaagctccctctaggttggaagacatgatccttccaatcatgtttttactcatttgtcacactattttattgagacacctcttgaaagttcaggttcatgatttctgtttctatatgcccagtatcccccatggtacttggcacatggcagacgctgagtaaacccatgttaaatgaaagaatggacacacatgtgaaattctttaagcttatcttaactgttttatcagactaatgagacaagcactgaacgaagaatgaaattgagtttggcatttgtgatgcagctatggccctctaagcaaagctttgatcttgagcttcctttctaattctagcattctatgattcaactctattaaaagtccattgatacccttgccagcaccagttgccttacaagcaggaccaccggctgggcatggtggctcatgcctataatcccagcactttgggaggccaaggcaggcggatcacgagttcaggagttcaagaccagcctggccaacatggtgaaaccctgtctctaataaaactacaaaaattagccaggcatggtggcgagcagctataatcccagctacttgggaggctgaggcaggagaattacttaaaactggaaggcagaggttgcaatgagctgagatggcgccactgcactccagcctgggcaataagagcaaaactccatctcaagaaaaaaaaaaaaaagcaggatcaccaaaaaatataattccacaatgttgggacttggatcaaatggcatcagatagcaggcatactctggcagcactctgtgccaatgtccaaatctattaagtttgtttactaactagtcttattatctgtttcatgttgggatttctttaggatgtggtaaaattggacagatgggttgaaagtcttccttcaggcacaatacacatagcattgggcagatgggttccaataacctacctttaggcctggaacacatggatgaaacaaagagaaaaagaatacaccactatccagtgatgggtagaaaatagaattgggaatggagaaatttttaaatgagacctgaaatatataaagtaaaactggaaagtggcacagtgtcacttaccttcaaaggtacaaatttttcagtcagcaagctatatattatagtaatgagtgaccttagaaatctaaatgtaacttactgaaaaaagagatcaatcttagcaataaaagatatcaactggaaataagttttgtagtaacaagaacagggctcaactgtatttaatatctctcaattaattggatgaggattttacagaatagtaaacaaatgggcaaatggcagtaatctgtgaggaaaagaccagacttcaagagaatatctgcagtgtagaaagatgaactgaaataattaaatgaagggataggtaaaaagtattgcccttagattccctcaaaacccaagggaaagcaaaatcagcccaatacaactgtacaatgtagagatatgtatttgtggcagcacaaatataaagagcaggaattagagctgacagtgtagttggcaggactaatggcatgacctggctggaaaaagaagttagtttaatatttgactgtattaacagaagaatcatatctgttctgatagctggaggctgactatgctggagagcttctgttgacacctccatttccaaactctgtgcttctccaccctacccagtgccccaggatgtggctgacctatgtgtactgcatcaaggagttctcctttattctgacttctcctttattctgacttccagtcggatgtggccaaatggtagcacaagcagaagacaggagggaaacaaaagaatgaggtaagagtgtttattcctatagttccttccatgtactggttaaatcccagccatacaaaggccatgcctctgggatggtctgacaaccatctctaaacctccctctttatctctgggttcctataacattcttttctcaatcctttatggcaagaggtagtaaggataactggctttatgagccctagggtatacctcatcccatttggatctttgtaaatcatttctttatttaaatcccttcaaactgtctaatgcatatgacatatattttctgtgggcaccctggctgataaacatttattgaacacctactacataccaagcacttcctatgagttatgtttaatatccctctgaagaaggttctactcttatcccacatatgttgcagatgaagaaatgaaggtgcccagaggttgacttgcttaaggtcaaacagccaacaggtggccaaggtggatttggacccccaacatctgacttagagcccattctgttaactgctatactcatctcactctgttcagaatagtcagatcccacctgggaatagttctttctccctggctttcagaggaattaaacaaaacaaagttgtgtttagaggcaatgccaataagaaagagggaatctcataactatgggaaatggggtgtacaaatttgtaaaatttttctgaaaagcaatttggcagcatgtattaaaaatcttaaaatatgttcttatccttaggcccattaatttcatttttaaaagcccatcctaaggaaatgaagatatgaataatgatttaattattgaatgttcattgcagagtgagttacaaggacaaaaatctgaaataacttaggtgcttaacaatagaaacatggctaaattattatatatacatgtatatctatatattcccatatattatataatgttgaaattattgaagttgggcctttgaaatataatgagttgtggaaattcttacattgtttatacaggatcaaaaaaatcaaagtatgtaccctacattttgaaatacatgtgtgcatgtgtatgtatgtgtaagaaaaaaaatgactttgagataaaacaccaaaatattaattgtggttatatttgcacttggaaatatttgcacttggaaactttgagtgatcacttcatttccaccacataattctctttgtttttctgtgtttgcagttttgtaccatagactaaaaagaaatacttaaaacagcaataactatgaaccatggttataaactgtatgacctaaaacagaaaagattcaaaaagatgtgaatgaagggctatagaattaaaaggagtaagatacttgtcctgaatggctcaaggggaagagcctgaacctatagaaattagaggaagatagattttagcttaatagaacaaaaagaattctaataggattttaaacaatgggaacaggttgccttgaaaggttttgatttttttgtcactggaagtattcaagaaaaggattgaccatattttttcagaaatatttttacagtaacttaacctttgttcaggtaattagacctagaattttctcccaactgagattctaaaattttcatgctacctaacaaggatatctaaatatttccttaccaccagagatatatttctttggaataagatatgatttttttctgggcattctctttcaatcttcttcctggggcaaagtaaaatgccttactaaagttctaaattagttcctttggagacagggtacatgtcttttcagcatttatacctattgcttacaacagttctaagtatatagtctacccataacatttcaggtttttttatttaagtaagccaaatctggttaatacactaccctagatccattccattctgcctgtcctgtggcctcaacaacatgatccacttcccagcaagaggagcctcatctccgagcacctactgattctctggtccttccactagctacccagggagccacaaaaataacaaagtcagaggagttaatggcatggaatgggccaggtgagatgcttgccttctcctcactacctcttccatattgtcccaagatatggtggttctaataaggcttctctcaagatatcccacataaccaagcaaaccaagcatgcttctttgagaagctgtggctaccttgtatttgctttccctccctttcctcctcacttttcttttcccttcactcacacatctttgggattatttgtcccagtaaagtgctagcacatagctttgctttcaagtctgttttcccaggaaattatgttaagacaacaattgaaattttattgtgagttagttgatcagatgatatcaaatccatcctatgatatcttctgaaagagcgagttaaaggcatattctgacacaaagaaaacctaaaggaagaattgatctgtagcctggaggaggtaaaaaatcaccctggaatgagcagtagcaggcggaccagaaacagcctgatagtacacgggcatgaaagaatgaccaatacaagccacctctgaccacatgtaaagcttgccgaagagcaactttactggtgcactcactactaccttaaccctccctaaactctgttaagcaacctgcttgatgataccatctgtttcccagagccccttctcacagaatataattctcaacatgctcgcaatccttgtgcctttactcaccaactttcagctccccgcctgcaatgaccatgcatgccacactcagaacattgcttctgtccacagggaagtctaaggtccccatcacatacagccctttgaagaatggaagatctgtatccacaaggacagttctgtctgtggaagaaaaagaaattgctcagatatgtcacaaaaacaagaattacgtgtttattctggggttctcccagcagtttgggagctgtgtacagtgttatctaaaccaggacaggtatagcaactggaagaacaaatagtctgccaaaagctaggacttactgaacaggaaaataagttctgattgataaatgctgcaattgcttaacataccacattcatggacaaaatgcactgcttatgcaccaaacagctgccccaagtctagtgcagtggaaacacacagatcgaatgagctccctaccctttgtcctgtctcttcacttttggctctagtttcagggatgtacagaacagtagacatgacattggcctctgagggaagactatttggatgtgaataccaattctgctacttactagctgtctaggcaaataactttatctctctgtgcctcggttatctcatctgtggaatgggaataatactaaaaacaactgtttcgttcacaggactttttgtgagggttaactcatttaattgagttaatagattgaaagtggttatacaatgttagtaagctatctctaattccctaagtcccattgtgtaaggtaaagtacatggtgcatgcttaataaacgcttgatgttattatttttactgttgtcccttagcttcccatgcttatagtgcttactggacaatttaaaatcattatattttatttcccctttcataaaagcagtcttcatataacttcagaagaaataatcatagctgttgcctgagatttactatagagtaatatataaacacaacattttcatttaaaacaataagtatttcatgtatgccaaagcattaagtgttactttctgaaatttagcagtaattcaacactataaatgacatcaaataaagatttttgcttaaatttctagtaccataatcaccaacacatgtaaagatttataaggaattcttttgttagtataatctcatctctcattctaggaaacaatgcacttgctcttcttaaggacatgcccaagcaaattaacttgtcatgagttgtctttcctagcccctccctgcttcctgcattataagaatggccatgccctcctgtggcagagactatagggttgtaaaccaaccatttctcttgttttcctaagttcacagttagactacagtttccacctcctttgcaggttgatgaagccatgtgactgagttgtagccaataaaatgtgggaaaaattaaagtatgacatctctaggcctgttccataaattctgtatgccttttccctccccttttctctcagttagatgtagagcagtggttctcaaagtatggtcctatcccatcaggatgcaaagcaagcattagttctgctagcaagctattctctctcctcactggctccaccactctccctggggaaacaacctctctcttttacactccagtgacaccctgtacatacatctatcagagtactgagacacattattcaaattatatacatacattattgtacgtgaggaagtaactgtcactgggctggtcctcagtgtgattatgacttcctctcccactctgacttccttaagtgaagagatcattctttttctttttaaatccctagtgtttttgcaatactgaagataaagacactaaataaatgtcgtccagatctgttgagtttaatcccctacataccttaaattcaagagctcattgatgactggtacaaaatgaatgatcaagctaaacagacaaaaataaatatatatcttaatctcatctctagcacttttcaaaatattcaaataaaagagtgaagtacctagagaatgttctaggtttagcacacattttatgggttcatgactttaagaattatttgaagcaaaatttgtaaaaacaagagggttttgcctccaatttatttacttatttattttattttcatcttttattttaaattcagggatacatgagcaggatatgcaggtttgttaacacaggtaaacttgtgccacggtggcctgctgcacagatcatcccatcactaaggtattaaacccagcatcaattagctattcttcctgatcctcttcctcctcccaccacctgccctctgacagaccccagtgtgtgttgttccctgccttgtgtccatgtgttctcatcacttagctcccacttacaagcaagaacacgtggtattttgttttctgttcccgtgttaggttgctaaggataatggcctccagctccatccatatccctgcaaaggacaaatgagataattctcattcctttttatggctgcatagtattccattgtatctatgtaccacattttctgtatccagtctatcattgatggacatttaagtttatttcatgtctttgctattgtgaatagtgctgcaatgaacgtatgcgtgcatgtgtctttaaaacagaatggtttctattcctttggttgtatacccagtaatgggattgctgggtcgaatggtatttctgcctctaggtctttgaggaatcgccacactgtcttccacaatgattgaactaatttacactcctaccaatagtgtaaaagcattccttttgctccacaaccttaccagcatctgttgctttttgactttttttttttttttttttgagatggagtctcactctgtcgtgcagtggcgtgatctcggctcactgcaagctctgcctcccgggttcacaccattcttctgcctcagcctcccgagtagctgggactacaggtgtccgccaccgcgccttttttgactttttaataatagccattctgactggtatgagatgatatctcattatggttttgatttgcatttctctaatgatcagtgatgttaagctttttttcatatgtctgttggctgcgtgtatgtcttcttttgagaggcatctgttcatgttctttgcccactttttaatggggttgttttttcttgtaaatttaagatccttatagatgctggatattagacgtttgtcagatgcatagattgcaaaatttttctctcattctgtagcttgattaccctgatgatagtttcttttgctgtgcagaagctctttagtttaattatatcccatttgtcaatttttgcttttgttgcaatggcttttggcatcttcatcatgaaatcttcacctgtgcctttgtcctgaatggtattgcctaaattttcttccagggtttttatggttgtgagctttacatttaagtctttattccatcttgagttgatttttgtatatggcttaaggaaggggcctagtttcagtttttctgcatatggctagccaattctcccagcatcatttattaaacagaatattcttcccccactgcttgttttttgaggtttgtcaaagatgagatggttgtaggtgtgcagtcttatttatgccttctctttctgttccattggtctatgtgtctgttcttgtaccagtaccatgctgtttggttatgctgtttggttactgtagccctgcggtataaagttgggtcacatgatgcctctagcttttctctttttgcttaggattgccttggctattcgggctcttgtttggttttatatgaagtttgaaatagtttttactaattctgtgaagaatcttaatggtagtttaaggggaatagcaatgaatctataaattgctttagatagtatggccattttcatgatactgattcttcctatccatgagcatggaatatttttccatttgtttgtgtcatctctgatttctttgagcagtggtttgaagttctccttaaggagaactgttcacttcccttgttagctgtattcacaggtattttactcttcttgtggcaattgtgaatgggagttcatttgcgagttggctcttggcttgtctattgttagtgtatggaaatgctagagatttttgcacattgattttgtatcctgagattttgctgaagttgcttatcagcttaagaagcttttgggctgaaacaatagggttttcaagctataggatcatttcatctgcaaacaaagatagtttgacttcctctcctcctagttaaatatgctttatttccatctcttgcctaattgccctggccagaacttccaatactatgttgaatgggagtggtgacaaagggcatccttgtcttgtgacagttttcaaggggagtgcttctggcttttgcccattcaatagaatattggctatgagtttgtcatatatagcttttattattttgaggtatatttcttcaataatttattgagtttttaatttgaatgtatgttgaatttatcaaagggcttttctgcatctgttgagataatcatgtggttttggtctttagttctgtttgtgtagtgaatcacatttactgatttgcatacattaaaccaaccttgcattccagggacgaagactacttgatcatgctggataaactttttgatgtgctgctgtattcagtttgccagcattttgttgagaacttttgcattggtgttcatcaataatattgacccgaatttgtcttattgtcaggttttagtatcaggatgatgctgacctcataaaatgagatagggaggagtccttcctttttaattcttggaatagtttcagtaggaatagtaccagctcttccttgtaactctggtagaattcagctgtgaattcacctggtcctgggctttctttggttggtaggctacttattactgccccattttcagaactcattattaatctattcagggattcaattcttcctcgttcagtcttgggagggtgcatgtgtccaggaatttatccatttctcccaaattttctactttatgtgcaagaggtgtttataatattccctgagggttgtttgtgtttctctggggtcagtggtaatatcccccttgttgtttctgattgtgtttatttcaatcttctctttcttctttattaatctagctagcagtctatttaattagtttttttttcaaaaaaatcctagatttgttgattttttgaaggcttttcatgtctctatgtccttcagttcagctcagatcttggttatttcttgtcttctgctagctttgaggtttgtttgctctaggttctctagttcttttagttgtaatgttagattgttaacttgagatctttctagcttttagatgtgggcatttagtgctataaatttctgtcttaatgctgctttagctgtgtcccagatattctggtatggtgtatctttgttctcatgagtttcaaataactctttgatttctgccttaatttcattatttactcaagagtcattcaggaggagaaggttgttcatttccatggtgttgtgtggttttgaatagatttttttttttttttggagacagagtctcatcactctgtcacccaggctggagtgcaggggtgtgatatcagctcagtgcagcctcctggattcaaatggattcccttgcctcaggctcctgagtagctgggattacaggtgtcttccaccatacctggctaatatttgtatttttagtaaagacagggtttcaccgtgttgcccaggatggttttgaactcctgaactcaggcaatccacccacctcagcctcccaaagtgctgggatgacagctgtgagccactgtgcctggccttgaatagatttcttaatcttaagttctaatttgattgtgctgtgctatgagagactgttattatttcagttcttctgcatttgctgagagtgatttacttccaattatatgatcaattttaaagtaagtgctgtgtggtgatgagaacaaggtatatgcctttgttttttggtggagaggtctatagatatctatcaggcccactttatccagagttgagttctggtcctgaatatttttgttaattttgtgtctaaattatctgtctaatattgtcagtggggtgttaaagtctcacactattattgtgtgggaatctaagtctcttagaaggtctctaagaacttgctttatgaatctgggtgctacagtattgggtgcatatatatttaggatagttagctcttcttgttgaattgaaccctttaccattatgtaatgcccttctctgtcttatttgatttttgttggtttaaagtccattttgtcagaaactaggattgcaacccctgctttttttctgttttccatttgcttggtaaatttttcttcattcctttattttgaacctatgtgtgtctttgcatgtgagataggactcttgaagacagcacactgatgggtcttggttctttatccagctttaaaagactctatgtcttttaattggggcatttagcccatttatatttaatgctagtattgatattgtgtgtatttgatcctgtcatcatgatgctagctagttattttgcagacttgtttatgtggttgctccatagtgtcactggtctgtgtatttcagtgtgtttttgtagtgactggtaacagctttttgttttcatatttagggcttccttcagttcttgtaaggcagatctggtggtgccaaattccctcagcatttgcttatctgaaaaggatcttatttcactttcagttatgaagcttagtttgtccagataagaaattctaggttgggggccaggtgcagtggctcgtgcctgtaattccagcactttgggaggctgaggcaagtggatcacttgaggctagaagttcaagaccagcctggccaacatggcaaaacctcgtctctactaaaaatacaaaaattagccaggcatggtgatgcatacctgtaatcccagctacttgggaggctgaggcacaagaattgcttgaacccaggagacagagttgcagtgaaccgagatcacaccactgtactccagcctggggtacagaggaagactccatctcaaaaaaaataagaaagaaagaaaaagaaattatgtgttggaatgtcttttctttaagaatgttgaatatctacccccaatctcttttggcttacagtgcttccattaagaggtctgctgtttgtctgatgggcttccttttgtaggtcacctagcctttctctggttgcctttaacatttttgcctccattttgaccttggagaatttgatgagtatgtgtctacggaatgatcttctcatggagtaccttactggggttctccgcatttcctgaatttgaatgttggcttgcatagctaggttggggaagttttcctggacgatatcctaaaatatgttttccaaattggtttcattctccctgtctcaaagcaagagttttatacaaattggtttatatctgttccaacctatagcacactcaaccaatattcagctattaaacctgattgtacaaaacaataaaattggttgaactaatgctttctctcatccacagagtactcacacatacacataaaagtatgatagtaggtgcttttagatgtatttctcagctaaaatatgacaagtacatgaagttttaattatacccctttcagaagaaattttccctttcaattgccctaccaactccaaatgtaccaacaaatttcccatgaatcacagacagactattataaccacttgagaacaggaacacagctgatgttctcacttttattttctcaggacctagaagaataatatttaacccataatagatggtcaaaattaacaccacacacacacacacaagcacacgtgtgtacacacacataaattccaatagttatctaaggaaaagtatagaatgaagacaataacagaaacattagtcttatttcttttggtgccacactcttcactttgaaattccctggattcatctctccattttttcttctttctttctttctttcctttcccataatgtgacaaattttgaggtggtaggaatttaaacatgagtaagtcatgtttcccaccatcagatgaaaacaggtatatatacaaataaataatgtgatatacttgaaatgatgacatactttttaattacatggaggttgactctgtttttattcccagctgcttcaaactggagtctatcaatgtgtctattataagaaaattctgctaaaataaaataagcacatgccatatagagatttttataaaggcattctccttgtatcacaataataaatatttcagctagttacatgagcaaaagaattcaccctaacgtaccctccagagcagatcatctgcaggtctaaactgacaaatcctcagctacaatgacacttgcagaggatttctctcttttgaggagtggaaagctggcatctatgtgccacattctctagaattaacatcctttccataaaattactcaagatatttcagagcaatcactcagaaatagttatttatacaacttacttaataatataagtgatggaccacctctaatttaagtgtgttccagtgctttccaccgtgtcctgccttggctacagatattccaccctatcctgtcagtgaccaatctatcctacttgagagaatcagcactggcatatggagggaaccatctggaatttctgttgctcaatgggtggctgatgggggagctgatctggaaagaggctccaaaaagaattaatgagttccagatgtaattaaagactgcttttccccccaaaggggctcaggactagccatggggtggtgcctcttggttccgaattacaccctttaaccacttgttcatccatcaagcactaaacaccaccatctttatcctagtgtgttttgccaagcagtgttttggctttttggtctttttttcctgaaagtgttctatttttacaattagaacactaaagctttaaaaataatatctggaaagttaacaataaggagaaacccctgaatttatccctgcaccaaatgcaacaacaacaacaacaaaaaagactcagtgttttattagaaatgcattaactagcctcaagaccagaaaacctgagccagactgaaagacagatgtctctgaaagagggctggggcttcttttgtatcaagaacaatttgactaccacagttacaaagcattccatgtaagttgaacgctagatttaaactcactttttttcccagcaaagtagggaatcaaggtcactattgtgtagcattccaagggtctgacacttgtctaaatcctgtagaaatgagatcaagggcaaagggcacagatcctgggaataatgatggggtcacatgaacaggcataatttagggcaggcagacccactgcttgtatggtatgcactgtatcaggccccataacttaggtggtaagacagtttctattacaaccctgctattgtcaggaaagcagcctgtactgactttggacacagctcagacttctgagggagagcaatggcatgccaggcagagcaggacatacaaggactatttgtgggcttgttattttcctgtaccttccataattaatgggttttttttctacattcagccttggctcctgtgttttctattaaatatgtgaaccaaaggaaaagtaaattttaaagctatttgaatcactattaaatgatctaatcttcctttgtagaaagaaaatatttttagctccaaagtgactgctttaaatatacattttacacaatgattggtgatattttctttcttttgtggtctcgtttaactttggaggcatctaacaatttatttaaatagtctatcataatttataaagatgaatgataacatccaagaaaagtattcctaaaatagaatggaaactcttatacataaatagttcacagagatgaaagatgaacatgattgaaaattagtgtcaagtagactaatttactgagatgatggtattcagttctctagagttcattctcttgtagaaaaagctgaccagagatgtgctagaagataaggatgcagtctttctataactaaactcttttcaaagaagtgctagctttatagtctgcctttttcatcaaatccacacaggtggtttctttattctactctgcccatcattttttttcaaactggtcttaaaaataggcagaagaggcagtttcaaagtgcccagaggcacacgattcaagactaaaagccagtttcctgacaccctgaagaaaaaccatctgctggcctgattgtgtgtgtgtgtgtgagagagagagagagagagagagagagacaggatggaaggggaggagagaaaaatagctcttctcactctcacctcatgagaagagtcccatttaaactttggacaataaatccccatcccactccccacattctttctgtgtctttttcaatcacacacagacatgcataattcccatagtagaataaacattttaaattatgatattttaattgatcaataaaatgtttaacatacaatgtttatttcttcctctagtctataccatctgttcttcagaaatattttgaatctatttaataggaaggtttttaagtaaaattaccaactgtatcagatcagtcctctgcatcccaaattctgaaaggagaataccagaaggtgctgctgttttcataaaaatagaaaagaatctgtgccttctctcatcccaggctttattattattgttttaaatctagagacggtgctatgctactgttctcttcatcagacttcaaagaaatcagagtggacgacatggcattgccatttaaaccaaggtctatagttgtcaccttgctcagatggctcaaggcaaaaacaacaacaacaacaatcaaacaaacaaaaaacctagaccttgcaatccccagaagacctaaaaaggaacaatatgcattttgataaattttaggtctgatgttaaactacagtttggctttatccacataattctattacctgtatacattgttaatgaattctaactaacatgaggtttggagataaaatccctctccaatcctgtagtgaataatgcttaatatgtgaaaaggcataaactggcaactctcaggtgatccaattattaaatttttacatgttacagttggtgttaaagccaaactaagcgccaaacttattttcctatgtgggtttttgttttgatttgtttccttaagaataataacatgatcaacttttagtaaataaatatattttgtacttttaccctgaatagaaaaatatgaatatctatgaaataagtgattcactcctgaacggtgctgtttaggcaaaggtccagatatcaaatattgtatcaaataagtttatttctccccatcaggtcttttttgaaaataaatcttctctttttgtctctgcttgacactagacagggcaatatatccaaaaaactatgagattctttaattttcctcggtattattgactttttttcttaagttctcaattgtttcttctgcaggaaaagaaacccaaaagattattaaaatcttaaaaataagatgcttgtatcctatttgtttgttaaatatacatatattatatcaattataattgatgtttaagagagagtttaaaatgtagtatctgagtaacaaatatttagtaaataatctctactttctattttaatatgttgtaccaaaatttatattttctgagcaaaccaatctatatgttgtgctcctaaattaataaagtgcttatattttataaagtacaaaataacttctgtagaagttgtcattgttctcaatatttttatattttccatattttttggaaagtccccaaaaattaactcccttaaaagtcttcttgtaaattccagtaaattacatgtattcaaagcaaggagttcttgcttggggtttccaaaatatgttattttccacttgaattcgaatattgtcccagagatcatgaaggttcctagaatgtttattcacaattctaactattctaacaataatatctggattctacaacctctatcaaaagtcccaatactctaaaatatccttgcttggtaaacatactgaaatccttgtccttagagttaattcctctttttaatccaagatgactagaagaccccaggagaaaaatgatatataaagaaaaggtattatcactgaccaatacatttgctcattcatccattcattcacttagcaaatactaccaagtgctttgtcagacactgtgatatatgccaaagaaacaaacataaataaaacaaggctcctacttcacatagagaagaaattttttttttgagacagagtttcactcttgtcacccaggctggagtgcaatggtgcgatcttggctcactgtaatctccgccacctgggttcaagcaattctcttgcctcagcttccctagtagctgggattacaggtgcccatcaccacgcctggctaaagttttgtattattagtagagatggggtttcaccatgttggccaggctggtctcaaactcctgacctcaggtgatctgcctgcctcagcctcccaaagtgctgggattacaggtgtgagccaccaggtaatgaaattgatgggatgagttttggaagaacaaagaagtagatgtgaagtccttttagtatttgcttgtgatacccaccaaaatgatcatggcaaagcccaggcaacatttcaaagtaaaaaagactatgtctgtttcttcctactttcgagtgcccatccatctctgataaactactgacctcatttgctcataactaccaaatggccagaatcccactgatgcccaaccaccaacagtccacacagatgaagggtctcagtagttctatagttccagtaatttctcagctgtgtcccaagtccctctaggctcaactcacttatacatgactaagtagagaaatactaattcattggggggggggggggcggtaacaggagaaattaagcgaaatgccacataaaaaattattacagtggctggcacataaaaggcattcaattatcagctattgttttcatatgcccaacatgtagcttggagtacttgctctatacctgtcacttcgctattgtgtgaaccaaagagacacagttcttggcctcatgaaatctaaaattttgtggaggaaataagacattaatacacaattgcaaaacttcataagcacaaactctgcaaattggtaagaagaaaaatacataatactatgagagtaacagtgagggatcaagggtgagacctaaagagtgagcagcagttaactaggtgtagagttgctccagagaaaggaggcaggacagatgaaaagtcagaagcgggaaagagctccatacatccaaaagactgaaaagcgagaaatgcaaatcaaaatcacaatgagataccatctcacaccagtcagaatggctattattaaaaagtcaaaaaataatagatgctgacgaggctgtgaagaaaaaggaatgcttatacactgttggtgggaatccaaattagttcagccactgtggaaaaaagtttggtgatttctcaaagaactaaaaatagaactaccattaaaaccagcaatcaccttactgggtatatatccaaaggaaaataaattattctaccaaaagacacatgcacttgtaggtttatcacagcactgctctcagtagcaaagacatggaatcaacctacctgcccatcaatggtggattggataaagaaactgtggtacacatatgccatggaacactacacagccataaaaaagaataaaatcatgttctttgcagccacatgggtgctgctggaggccattatcttaaacaaattaacacaggaacagaaaactaaatactacatgttctcacttataagtggaggtaagcgttgggtacacatggacatagaaatgaaaataacacactagagactgctagagacggaaagaagggatgaaggcaagggctgaagagctacctattgggtgctatgctcactacctgggtgaaaggattcactcatatcccaaacctcagcgttatgtaatacttacatgtaaccagcctgcacatgtaccatctgaatataaatgaaaagttgaaattatattttttaaaaaagactgaaaagcaacaggaatgcccacattgctgaatctggaggagagaggtaagaggcagggctagaaaggcgggcaagagagcagattaggaagactatgtaaaaacaatgagatttttgtcatgataatgaaagtaagccactaaggggaaatgaaagagggaaattacacagccaactcatatttttcagagtgctctggctgcagtgggggagaatggagtagatgagggtaagcacagcaggagaagaataattaagaggcattctatggctgcatagtattccatggtgtatatgtgccacattttcttaatccagtctatcattgttggacatttggcttggttccaagtctttgctattgtgaatagtgccacaataaacatacgtgtgcatgtgtctgtatagcagcatgatttataatcctttgggtatatacccagtaacaggatggctgggtccagatggtatttctagttctagatccctgaggaattgccacactgatgggaggggggagggataggattaggataggattaggagatatacctaatgttaaatgacgagttaatgggtgcagcacaccaacatggcacatgtatacatatgtaactaacctgcacattgtgcacatgtaccctaaaacttaaagtataataaaaaaaaaagaggcattctagtggttcacccaagaggccatgatgcatatattagggtggtgagagaggaaattaaaaaacacatatctgagtaacattcaagaagcagaatagccaggattggataaagtgtcaagaacaaccctgagcaattgagagtggaagatggtgccatgtgctggaatgggaaagctggaagaagagtaagttggccactggcaatggcaggcttggtagggagagagcaagaatagaggattctctctgagttattttagtttaagataactgtacatcatcccagtgcagatttcaagtggacaattacacatataggtctgatccttgggaaaagacaaaacatatttatgagttcaagaaccatcaatagcttcacaactagaaaatgtatgttctccaaaaatcaccaagacagaatgagaagaatcgttatctaaaaatagatgagggtttttttttaattcaagggagtttttaaaatcatatggagcattcaaaaatgtgtttgctaataggaaatgtcatatagagagggaaagactgcagacaagaaagagaaaggaaggagacaattatggactgagatatctgaaaaggaataacagcattaagatgcagagaacatcaggtgggattatctttgggagaaggtaaaacactttgttacaacaggaggaaagaaagagaagaaaggggtgctgcaatttacatatacttgtctcctttaaagaggagcctgaggatacctaaaataccctgcaaaagactatgaacttgggacacactttcagttcacctctaaatcatatcatgtaaacattagacttcttctgctaataaccaatagaaatcagggatgatctctactataaaactctgtgtgtaaaaatatatctatctggccaggcatggtgactcatgcctgtaatcgaagcactttgggaggccgaggcaggttgatcactgaggtcaggagctcgagactagtctggccaacatggtgaaaccccatctctacttctctactaaaaaaatgaaaaatattagccaggcatggtggctcattcctgtaatcccagatacttgggaggctgaggcaggagaattacttgaacccgggaggcagaggttgcagtgagccgaaatcatgccactacactccagcctgggcaacagagcgagactctgtctcaaaaaaaaaaaaaaaaaaaaaatatatatatatatatatatatgtatatgtgtgtgtgtgtgtgtgtgtgtgtgtgtgtgtgtgtatccatctatatgagcatctggcttaatgtctacttaaaaaactttattaccttaacaccatctgaacaggattcttttaaaagtaactaatgagaattaatacgtaagaatgagtgactgctgtataaatacataaaatagttaatgaaattaatgcacatgcatctagacatccatatatcaagccaagcatgtattttacatatggagtctttgtatccatccattcattctcgaatagagactagttctatattacaacatggatgaaacttgagaacatcatgcagggtgagaaacttcactgtatgattccttttacatgaaatgtctagagtaggaaaatctgtagagatggaaagtagattaatggttgcctgtggctgggggagattgcggactagggagttatagcctaaggggtatggggtttctttggggggtaatcaaatgttccaaaattaattacagtaatcgcatgtctctgtaaaaaccacgaattgtacaatttaaaaggatgaattttatggtatgtgaattatatctcaataaatctcttaaaaattaaagtactttttgtactaatatggaataatcatatctttctatactaatatggaataattacatggaataataatagcttttaaagcaaggcacacatagtgtacaatttgtaatatttatacaaagggagtgaataaaaataaatgtagtgtgtgttttttttaatttttgcatatgcagcacagaatatctttcgaaagataccaaaggaaggaaccagtaacactgccatcttcaggaaatgaaactggctggctggaagacatgggtgaagggaaaattttcaatgagcaatctttttctctttgaattttgaacaaagtaaatacactactttaaaatcttttaaaaaattgaaattaaaattaaaagtagagactagtcataattttatttgaaatgcaaattaaaaaagaatctctcacacacacacacacatttgcatgtgtgtgtgtttatgtatgtgtgtcttttagtccttgtcagacatgtaatttttttctgctgacaggaatataagaaatatgagcaagagaataagctgtgcagacttcttatttgacctggctttgacttcctgtttctaatgtcccttaatttacattttgataggtaatgttcctttctcattttatcttcatatttgcaatttttacatttggatatttatggaatgtggatctacgcaaaatttgactctgccattggaattggagttcagtatgatgtttcaatttattctgacttcagtttttgcttgctaagttaatattaggacaagatcaaactccattaccttgcatagattactctctagaaagttctccctattgccactttgctggtccataatcactggagacaacttcctgaaatatggatttatgggaaggcaaacaaagaattataaacacaaagaaaatcagaaaactatgaaagagatatactgaataatcaataatcaattcaatatcccaagaactaatactcaaagatacaaaataaagcaaatggaaaatttagcttaagcatattcccaaacacactttaaaaacacagaatattttagaagcatacaaaaatagtttcttgtatttccttttgattcctttatatttaatataagactctagttcgtctggcatggcatgacttgggaacacaacagaattttttttagcatgtgggtagacaactattccaacataatttactgaaacgtagtattttcccactgttttgaaatgccatcttaattactaagtacattcttttatatccatgggtctgtttctggactctattttgtctcattcactttcctctcctgcctcttcctatgacaatatcataccagctttatctagaccaatcctccccaaaataatgtttttaaaatccttgccagttgtatatttgcttttcctaaaaatattagaatcagcttctcacgttctaattttttttaatctaaatgcaattttaactaggcttacttgaatttataaatccatgtgggggagaatcttttcatcattgtgtcttcctgtatttgtacagcattccacctatttagcaaggttttcagggggtttttcttcacatgacatatgaattttttgtttatatctaggtattttacctttttccatcaaaagtggaatttattgtctattgcattttctaattagtgattgctattatacaggaatgctattgttccttgcatgctagtattgttgccagccattttacttaaatatcttgtattttttttctagaaaaaaaaaaacataggcttaccagtaattgttttcctgcttctttcaagtggctgtgctttctatcctatttttttcatgtactattgcattgtttggtatctccagtaatagaaataagagtaggcattcacgttttattctcgacactaacaggaatgaaattaacctttcacacttaattataatatttcctatggacttcttgtaaacaccttatatccagttaagagaaattcccctatttctgtaataataaattgttgttgagtattaacagatagaaatttatcaaatgcttttaaaaaaattgatttggggtcttggaaaacaccctacaaaattcactcgatactaccatgtaaacactttttcttctaatgggaagcagatgagtttaacatactgtaattgttaactcttgcccttaaccaagggatacaaataatctatgccacattcaagaggaagacagcatattttctacaccaaaagaaaacaacaacaaaaaacaggaaatgccttcaaaaatcttgttttaaatgtctgcttagatttcagatttctttactttagatgcttctataaaataacagagaaattttaccctcagtatcccaagttttccaagacttgtgattgggaaccataataagcctattaatttctgttttggttcatcttctccttcttcagcccactgataccatccttcactctgccccactgccctagaaatagttttctctgctcactcacccttagccacctaaaatatgtgacacttccccatggccctgatgtgccctggaaccttggacagtctgaatatttaagaagcccttactcagataaagacacagagtagtataggcagaagctggcactgcacgtgacaaggggaagaaagacaataaaacttatttagtcattcttggctctttatatatggaatatcgtgcctcattattataaaaagaaagtacaatcttggggaaacagagagacttctaattttgtcttactgaattatgttagattatttttcctgatattctagaactatccttgcattcctgggattaaaccctatttaactataatttgtgattctttggaagcacaggtacattggatttagtaagacttctcctcaatatcaatgagattagcctttaattttcttctttgtgccacctttatctaattatataatcaatcctatagccttaagaatgaattaggaagatttttatttttctccaggttctgaaagagtttataatatggtgattatgtgttccttgaaggtatgttttgcatttttaaagaagtaacccggatgatctcagctataggtaggctatgaattcactttaagatcaactgacctgaaaaaattctcccacttgaacaatgaggcataaatatttttgtcattgtattgtttataaaagtgaaaaaattggggtgaaaatttatgttcatcagtaagatggtaattcaataaattataccacattcctactctgggtaactacactgtcatttaaaaggatgcaggacatttgtcattactgatatgatagtattttgaatatagacttaacttttttgaaagtcacatatgaatacttagaacatatgcttttcattgctgaattaaggaacatcttagcatggcatataagagttctagagtcaaactattgggtccaaatattgtccctctaccaatcacttttatgatctctatttctcagtttcccggctacctgataaagagagatggtaatagtgcttcacagggtgttgtgaggattccaaagtgaattcatccaaaacgctaaggatagaaactgatatgtagtaaaatactcaattaattaatatttttaaagttattcattatataaataaatacacatatttaaaaaaatgtaatcccaactgagaatagcagttatccaggggagggcaaaaagaaagggctaaatggttcttgatattttgctttgtatatttttacattattttgaacagaaaaaaattatgtattatgtttaaaattttttaaagaacaaagttacagaagcctaatactaattgtaaagatgtcagatagccatatataattagatgtctaagacaagaaaggtattggactttcattcaggtacaaagcaacatggaggccagcatggagagagcagcaggaatgagacacacctggatttacatcccgctcggtccctttgtagctgtgggacccagggaatattacttatcctctaagctagggttttaatagctggtaggtccacagacaccctattagagtttcagtaccatttgcaaagttggttcaaaatatagatcactagtaatttagaaacatttccattgacttttatgcatgctaaagtttaagaaacaaaataaagttaagaaaccaaaataaaatacaataaaaattctaagcctcccaaccaactgaatggatcctcctctcagccaaggggattccaaagaaacctgaaaaattagctcaggccacgatgggaaggagtggtcatcagacatacctcattatacattcctgcctttggaatttaggtacaactgaccagcattaacattaaaacagagatattaaaactgacaaacagactattttggagcaataaggtactaaattccaacccaactctagtagagcatcacatgacagatagcaggtcctgaaagtatcaaagtattttaccgcaaaatatatttgtctgtcatattttgaaatggctatgcaaagctgtctcttatgggggaaatttatattctttagagaatcgcattccatctccaggtcttttttagatcctgaagagattagctgagagtctagtacctttcaaatgtctgaataggaaatgtttgccatctattacctctaagggtagtcacctaaagacttcatcttcataataagaaccttggtatgcacaaccctttatcttaacccagacactcctttctattgattccaggtttttagataataatttaactctttcaaccaattgccaatcagaaaatctttgaatccacctatgacctgtaagcctgcttcccacttcaagttgtcctacctttccagagcaaaccaatgtatacctgacatgcattcattgatgtcttatgtctccctaaaacataaaaaaacaagctgtaacccaaccaccttgagcacaagttctcaggacctcctgaggctgtgtcacaggacatggtcctcatattcagctcaaaataaaactcttcaaatattttgaagagtttgacctttttattaacagaactgctctcaattttgatttcttagtgtgtcaaacatggtgccaatgtcacaccatatttataaagctttagtgagataaaataaatatttaatactgtgcctggaacattaaaaaactgaactcatgttattataataacgggtacattgttgctagtactaccactgttatcaccatactctgtaataactgttcctgtgtttaaatgaaggatctgatatttcctcaacatgccatagccttctatggccttatatttatataacttattactttttctggctcaaaaaataaatgtgaatatctctactatttcctacatttttttttactggtaatattttgtggccttctgattttaacttctgaccactattattcaagtaacctgggatcttgaaaaagtaagtgcagtgcttggaactaaaattctggtatggtccttattaacgcaatatgatttgggcttgactgtgatgggagattgtagaaataggataggaaaagaaaagatatcggaatagtagagcttataagaattgtggttaaagttttcctctctgggtgaggcttgtactaagcatggggtggcaaaaactatgttattaataaaatactatattttctaagaacaaaccagccttccccttctctttgttacctgaaaaacctaggcataaagctacatgagtctttggtcctgattctccatttcctttggagggaaaaaaaaagtccacatttctcacacagctttgagggaaagactcataaccatacttaatgtataaaagctgtgatttccatgcaaactgctgctttcccagaaaaatgtaaaagccccctttagcagtttaaaaatcctttaaccatttccttcctgttccacttgaactaggggccagcttgctgtgccttaaagccttccttcagtggctttcagatgaataagttaattttagaagtgttagaaacatttttaattcattcagacttgcaagatatcattaaataccaggtacatacactaggagccaagaagagttactctacgattctctcagtcacagataatttccttaccatactgggatttaggcctagcactgcaaacagcaaaacttgggcttcctcacagtagccaatgtcatagctctaagcctgcaccaatgtttactcatttacactctttcttttatagtttcaccaaaaaagaaaacaaacaaaaacaggtgcatccacactatacaaatgagaaaaggtaacctctgaaaccatttcacagcaaacagaagatccacaagctgctcactagctaaaaccacaggaggtgtgtcaggcaccttgatgctgagccacaggaggcctgcaggcttggaaggcagtaaatccccagagagctctaaactcctgattggcaagccacaccaggcccatcagctcctcaggtgctgagccacaggaggcctgtcaactgctcaggtggaaggtgtgggaggagggaggaggcaagctgtgtggaggagcttgaatgaaaggccaccggctcaccaggggagacaggaaatgagaggtgcctactgggaatactagagttcagagaacttcatcaagaaaaggaacgaacccaccccctccttgcatcttcttacctgcagggaagcacatctcacagagagtacatttctggcccagggattctaaataaataaatgctaatgtagaatgattcccagattgagttctgcagcagaccaccaggtcttccagagaaaatcagcacctctttgtcagttgctaaggttctcagggaacggccaccctccatccaccctttgtttgccaagattctcagtatgacagtgacacagtgacatctcccccttaagtttccaaaagtcctggaaatactttagtagggactgactagtcagtgactgcatctcactctttcatttatttactctagcatttgttgtggctataagccaaatcctctgctttgcattagagatataaaaagtcaaataagacataacctctgttctcgaggtgacataaaagtaagtaatatttacagaataagggtatatgacagaaatatatccaaggtgttgtaggaacccagcggaaggagaattaaatcaaatgaggattcggggacactttctagaagaggtgccaccaagttgagtgttaaaggacaaaaataaataagctgaaagagaggtttagggtggggagggagagaaagggaaagaaaggagaagtggaaaaagttacaggtagtaagaagagcaagtaaaaataactggaaaagaaatagtcgattccatccaagaagaatgagtagataagtagaactggacaacaatgcatgcaggagaacagcagacgatgaggccagatcacaaagggctctgcagtccaaacaaatacgtttgaaatcgactctgaaagcttcaggaagcccccaagtatcatgcaacatcgatatccaagaccaaggcctcagaaaaattaaagcctgctgattttgaaaattgggtttctcaggtttctgtaaaggttaacttatttccaactaaataagaaaaaaacaagattatttcagattcatagtcagccttagctctggttcctgaagtaaaatttctcactttatattttgccacttggttgttaaatcttttgtgaaaccatatacatatatgatcatgtatagcatatatagcacatattttactaatatgtctttaaaaaaggatgcttgccatagtaaataaacagtaatatgatattaaaactcaagtaagtgccaaatattccttttctggaagggtaaaattttaaccatatattcccaatatgatttactttctcataaatgtattaataaattgctaattacacatatgtagtgcaatactaatgtaataaatattatctacatagtaaaacatagaaaaagaaaattttcaaggaatagaataaaaataaggaaaaataaaggttttgacattttctatttgttcttcagtaagtcatcattcaaacctatgttggaagccccctacttacttagacagctaagacagatctacacccccatgcctctgtgctctgtgcaattgcatgtagatgtctgtacacctttcattaaaccaaatcaactaaaggaagaggaaaagagataaggagagtggtgaggtaacacacctgtggtgggctttgtagccaataagaagctgaggcaatagagctggatgggagaagacacctgttaaatgaagtttagcctgaagctgcctccttacatattttaagtctggcttaaaggcttctctgcatatagttaattgtaacctaactagatatgtaaacagactgtaacctactcttgtgccaatcacagagtttcagccagtcaaaggcgaccaactgatcaaactgtgtgcaaaaaaggcaaatgctaagctgtaaccaatctggccatttctgtacctcattcctattttctgtatatcactttcctttttctgtccataaatcctctgccacatggctgcacgagagcctctttgagcctactgtggctcaggaggctgcccaatttgcaaacggttctttgctcaattaaactctgttaaatttaatttgtcttaaggtttttctttgaaaatacccttccctccactccctggggtcaatgtgagggtgaaggaaaacataaattatgaaccaagctcttgaccctctttgtagtacatgaaaagcaacctggggtgaaggcagggatagatacaggacgttttatccgaggagcaagagagagtcatggggcttccaggatagccttggccccagaagttctttcccatattaccagaactctgggatcttagggacagacttgttttttgaggggttttttttcccatttttctctaggagcatttagaagtcagcaatttgggaaccactctacataaggtatgtgcctctatttccttactacaggtgatcttgctaaatgtaaaccctattcacaaaatgtgtgtcatcataggatcttgcccacttctcttttccgcaggatttagtaagaaaaaaaaatgctattgtggtgaagattggaattatcaatacctcaacctatgggaggaaactctgctgtagacacccatccccctagatttctcaagaagaaggagctgccacacactacttcctgccctatgatatactgaggggagagggaaggggactggtgtgtcagtttcagagttttgattcaggactacagccgtgtccccagagcaaacaccccaaggcattcagcctcactatgccaacagcaatcattcctgctgatccaacacacgttcaccgattatgaatgaatgagagcggctgggatttaatcagcactctattcaatccaccatgcctccatccattcattcactcactcgctcactcctctaacaaataaacaaagaacttctactcttctggagcttccctggacacaggaagcacaaagatgagaaggccccattggtgccaataacattctggaagacagcagagaagtgcctgccatttgcaccccttgctgaccacagcccagacagcctgggcagagtgcagaacattcaccacctccgtgcgtgggctatacagacaccatctctccacacactactgctgcctgaaaaatgcagtcagatgggttgtcattaagcctgacaaaaacccagcaccatctaggtaagagcaatgttttttatccagacactaaattgcaatcaggttacgttatcatgtaaataaagaggcaaacagatggtttcaaacgagatccagggctttcagagcattgccgatgttacaaatgaagaaaagcaaggacaagccattagacacagagcgggccccggagtgcacagcagcccaacaaacagaatcctggcctggataatgcagccaaaacaaaaggcagtcacttactgcttgcaattgtttgttaatcaaataccactaatttccaaatctgggcaaatgctctgagaaacatatattcatactttttccataaaatatattttgcaacggtgtcatctgtgtatatcaccatgacccttaataacacagctttttaaaggctctgttttatttcctcccacatgtttaaataggaacagtgtaatgaactagacagactcagggaatccagaggcctagatttgactctactgtctctgttatctctgagctctttcttgggcatgccctcttgcgatcatttccctcaactgtaaaatgtgaaaacaaaaaatgtggccgaggccattagctgcttcccagtatttattttatcctcccttagtaataagaactccaatttttagctgaatagtttgtcacctagccaaaagactacatttcccagcttcctttccaggtagaagtggccacgtggctaagtttacactattaagatgtaaacagaagtgtcatgtgagaaataaaagaagaatcctttctcctttctgctgcctggaatgcggctgcaatggctggtgctccagcacattgatggaccaccgagtgactttggaaatagaaaaaacactggaggacaaaaaggtagaaggggtccaagtccctgacaccatggaacagatttttatgtaagagagatgtaaactgacatatctatcaacctcgtaccataataacaatttttaataaaaataataattttcagggtttttttattcacagaagacttaatcttcctaatacctggatacccaaacccctaattcttaatacctggacaacaaaactcccagaatggtcgtgagtgttaaattaggtgtgagaactctttgtactcaaaatgtttccctgaatcctcagcatgataagctgctctgtgaataaaagtgttacacgatcaaacatgctggagaacagctggtactatatccccctccgaaagttatacaacccatattgtcatataaaaggatttgaaaagaccagaaacaaaaaaaagtatttatctgtgcttagtccaaaatttttcaaatttgtttgacttacttttttttccatgtgatgcttacagggagctagtttcagaggaaacactttgagaaatcctgggtaaatttcttaccagtaatagctaatatctaaattgttgcttttagccttcaaatatgaattgtaattgaatttacttctatgccagtccaggtccaggtcttacagtatatgctttcattactctctgaatgtttcctatagcacatttgttagtcgtattcatttttaactacatgcaattacatttctatctccccagctaggcagtatgttccaggtgggtctcagaactattttgctcatcattttatctccaacatgaggcaaagtggcacataataagttatgcacccagtaaatagttgctgaataaatgcatgatttctgaactctgttttcatatcacacattatgcaaacagcagtgatggaatacatgtaaatcaattttggctttgcgaggggttttaatctcttttagctctcttggatggcatttggaccattagctccaccagtgcctatgtatatactcttaatgaactgaacgttagaatgtcccttctaagtatcattatttagtaaacataagaaatcctgagtaacattgacctaaaaataaaataggagatttttaacgtacttgcagataaagaaaatatcagaattctcaccaagacccattactgggttcaactggtctggatatccaagatagatcacttacatagctggaagctgagattggctcttggctacagcttatctccatctggggctgccaagcagtgcacaaaaatgacctttccatatgatttagattcccatagcctaaggtatgtgttccaaaaggaaacaccccaatggcaaatgagacttctaggcaaaaggatcttctaatgcaagggttcttgtgacctagccttcaaaatccaagaacattattctattaatacagtctgtcagtccatctagtcacaaaggccagcacagattccaggggagggcaggaagctctatgtccctatagaaggagcagcaagcatttataggaaggaacaaaatttatggtagccctttttggagaatttctgcaataatgacattgaaactacgatacctattagaaccagtgctaggtactgttactcaaccttctaacagaggagcatattatatcacattttattttaatattttgataaccataacaatataactgatttcttttataatcctactttattttatgtatcaaaaaaattatttagagaatgggtctaggctttaccagactgccaaagggatctgggacatataaaatgttaagaacccttgagctgcttaatagtgtggtaacctaagggtcagcaatgagccaactatgccattcctgcccctgctggcctgcctgtacctacaaagaccttgtcacttcagcaaagttcttatctctaaacctctgtacatgaggaaactccaaaagctccctcaagggagtataatcaactcaagaaatggcaactgtacctaaaccaatgattgggaaatcatgaattatttaattttacattccaaaaatatctgcatggaaaacagaccataaagagaaaaaaagtaattcaatgagaacacgtgaaaaaagccctgctctgcattaaaaactcccacgggcagctgctccttgcttggcttgtacttcccaaccccaaccaggggggtaaaatacatatgcaatcactcagtttcccttcttttgtaagaaaggccttggtaacactcctcaaagaatattaattccatgagacaaagttcttagggcaataaaactaggtaaaatatgtttatgcattttaatcaggggaaatttttattaaccctcagcaaacttgttgcagtgcaaatcatagaatatggggttggcacaaactttaatggtgatttcttagtagggtgacccaatcattctggtttgcctcagacttcccaggttttatcactgaaagtcctatgtcccaggaaacaccctcagtcctggataaaccagggtagcaggtcattctctttaccaatgattttaaagacattagttcctgatatttatgtctccaaataaatattaaaacctatggatgccactgtcggtattccagaactgaaaggaattaaccaattagctctgatagagtaatgttgcctgttttaaataacatggacttcaattcttacctccaggattgaactcattctaagagttatacataatctcctaaattttaaaacaaaatatattttgtattgtgttgtgtttttgtaatactctacttttaggaaatgacagggattcagtgatttcattttttgtttgtttgtttgtttgttttttgagacggagtctcgctctgtcacccaggctgaagcgctccacctcctgggttcaagtgattctcatgcctcagcctcccaagtagctgggattacaggcgcacaccaccacaccaggctaatttttgtatttttagtagagacagggtttcaccatgttggccaggctggtctcaaactcctgacctcaagtgatccgcctgcctcggactcccaaagtgctgggattacaggcgtgagccactccacctggctgacagtaattccttaaatgacataacctattctattttccaaatcaagctgattgagctatacacattaaccagtttggtgggactgagcctattacctgagcctattaatttagaacaccgggcagtactgtaaccagaaagtgaccagggacacaacctggctgccaccttaaaagtctgctcatgggcagtaatggtttttaattttaacaaagatatgggtatccttgaagacaccgatacaatccagatgtgtgaaactataaaacaagcaagagatgttacattagattttgcatttaattagtgggagcctgcacagaggatatagtttattctcaagcaatttccaaattaccatcctccttgtcctccttggaaaatttactgttaaccacctccatcatcgtggtattgctcctttcctgccttgccttctgctgtcctggttctaatttcatgactactcgttctatgatatctcttcctgaaacttaaattagcattgccctaagatgctgacttctacccaatccttatatctctctgcaatagctctcatatgagtcctaacccccattcaatactcaaggcttccttagtcaattcttctgagaattaccaaattgcaatccagattctcaattggccttcctttcaatcttctggtccacatttcccgttaccatctaggcatctgcacatgaacctgagtatatgactataatggaatttattatcctccctgctaaacctactcctttacatgcatcctctatttctattgatggtacccctaggcattcacctgtgtgcaaaagttctggtcatcttctcagctcatttttctttatttttttacaatcgataaattgttaaccctatcaattctgctttcccatcaagtttatggtacttattatatttttccatagcagccatcattgcatttactgctactatatagcttgtaatttgtattgttaaggtcaaagtatacttgaaatcctggggaaagtaatgcatagtttctttaagaaatagttgtaaactgctgctgaaagtttgtacaggttaagtaagagaaagaagttgctatagtagcaaaaaaaaaaaaaaattatacctattgcaactaaaggaaagcatcataggtgttttacaggaatacctgctagaatcctctcaggctacaacagaaggtgcccaatacggtcacacctctgggagactgaggtggagtatttgaaatcataaaagtagttattctctagatgggagcacataccaaaataaaacccgagtctcttatatacttcatgcttgccaattaccgccaccccatgatctttacatcctggggacgtgtgcccctcctagaaaattactatgatccatgatgctaatgctaatggaccatgacaatgagtgtgtttctcaggtgagtgaaaacaagaaaaggtttgtaaaagtcctctattagagtaaaactcgaattagttccagcaagttagcaagccataaagagtgtcaaggcctacctgactttggatcccaagagtagaccctaagtgagttctaattagccagaaacaaatgccatgactgattcaagcagacatggacaaattaagattggaaaaagaatctcaacctatttcaatatatttatatttttatgtttattctgtcacagggaaaaatgcactgctattttaatcgaaatttcatttttatgaagaaaagcatatatagttgagggaaaaattctttttaattcccactcctaattgtccaccctggcaaaagcactgtgtcacagatcttggttagaaagtttaggggactgctgctactcatttgggagcatccgtttgaatcgtggtcattgcaactagaaggaactccctagcctcaaagtgttttgtctcaaaattcaatcctattttaggaacaaaacaaataaatcaatagtagtccctttaataaattttaggggtcaacttaaaacactgggttgaagcatggggactaaaatttcactcagctttggtataaaacatcatataagtttgggcaataatcttaacatatgtcatagcattttacaatttataaaacacattattatttagattattattagttggattagaaagccactacatttcctgccaaatcaacaattctatgtgtctataatttacatatatattaatatttataagtaaatccacctcaaaagaaaacaaataaattactaggtaatcagttcatcaagggactccatatagcaaagcactttatacttagactgctttaaattgtaagtttctatagtatatttttaaatgatttgatatatgaaaagtttatttacattcatcatttcaaagataaactgcttggggatgttggtgagaacacctgctctgtggagtctgaaattcttccttccagtggtgaggacacgactttgacatccttaaagcaaggttcactaaggtctatgattctctctaagaaattgcctaaaaggaaggagaaatagacagtttccaaagatcctttcatctttgacttcaggttttctttttatttatttttattggaaaataatgttgattaaagtttttaggtcaaaagtagcttaaagaacagcttttccattcactttctaaagaaggtcaaaggaaagttcaactgttgtctccctggatctttaatgtctaccctgaaagaaaatgctcgaaatatgtttccttcatgtctttcctcatcccaccatatccctctcttctaagaagaggctctggtcacacatgtaaagatttgaccacaagttgcagttcaacaactaccgtccattcccactgcaaagtgagcaattccaaattgggggcccaattatgtttggagagttgacaaataccactttcaggcagagaagaggtggtgtaattaacactaagcattataggtaaaaataaaataaaataaagaaactaaaaccctttgaatagtctgtctcctggtgttctgtaatttcttattcatgcaagccaacagagtctaaataaagtctgtccagacagggaagacagcacaaatttagcaggctctaaagcactttttgaattaagtcaggtacatctgcttttaattacatacatgcatatatgcttacacacataaacacatacacagaggtagattaaagacagctgcaaattcttagctattcctcctattgagaggtggaacctaattcttctctcctaaatctaggctgacctcaggaccttgcttgaccaagaagttgatggccatgatattctgagcttgccagagccagcttagaaggcatgtggcttccacacaggtctcttggaccacttacttttggaacacctttcttaggctattctttcttggaatccagccatcatgctgtgaggaagcccaagcagccccataataaacccatgaggagaggaactgaggcctcttagttgattatcctaagctcccagccaataaccagcatcaaggcccagccatatgaatgacccatcttaaaggcatctaaaggcagccaaggtgagcctttcaatgaccacagtccagccactatctaactataatgcatggaagaacccaaattagaacacctcggcctcgcctttccccataaaattgtaagcaaaataaaatgtgtgttttatgctgttaggtttctgggtggtttgccaggtaatgatacagtttcagaacacccactccacttgtcaccattctgatgccacacattacaaaaaggaccccagtagctgaagcccaaatttcttcccttcccacttgctaatccagaataagtggggtggtgggctttactgcttttatgtcccatccaaaaggtacaagaccaaaatttgagaactacacaagctatagaaacatcaccaatatttgtttggtttctaattggtgttgtagacctacatctctgctataattcagtatgaaatactgaattacatataatctcagataagaaaaaggtgaatgaagtcaatagttttataatcacaagatttcatagaattcctcccctcaaaaattactttctgatttatgatcatcttgcttcatatcaccaacctattatgatcttttgcaatttaacaaggaggtgcattacatattgccatctttgaacatcacacgactttgataagcttctctggcatttaaggtactgaatattaaaaatcagaacaaacagaagagctattataaaagaaaaacagtactctcccattcatgtcttcaaataaggacagttcaaagtaatatacaaaatgtaacagtgaattctaccacacacataaacacacaaagatgctggaggctacatgatatcatatttgcacccttcaaaacagaatcctgagaaagcactggaggcatcttacacaaatccactctggtcagtttagaacaaggcatagagcagaagctagagggatcttttgccatttgaccagctattctttatgaaggtttgagatttgcgtagtaaggcagaacttgttcctactacttaagaagttgagaatgcattcaggccaatttttccaatatttagaaagcaaagacagtcagatacacttacttgttgaagcaaagttatcacgaacttaaactacaagagcaaattcttaatgattacctcagcttactccatataataccacagagaagaatttacagttctttcaaaatccaatgtccataaagatagaacgccttgaaggaaaatggtaccatacttaagatagtgatgtcttttattagtacagtaaagtcctatttttatggaataggatgggtctgaggtcattccataaaattgatttcccagaaaatggaaataggcaatttaccctaagaattttattgaaaaattatgctattctatttgaataatgatgggaatgttctacacgtttcctttattaatgaattaaaatacacaaaacaccataaaattatattagaggttcaaaagtatcacttaaatcttttttaccagtcactttcattttgtaaaatcagcagttccattaaaatcgtattatgtaaaaatgggtttttactgtaataatagttattacctatttagctcccaaggatgttgtgaaaattaaataataagccattggaaagcaaatacaaagtgttgctaataccagaggccaagaggggcagccagatggaaaaatgaaggaaaagagcacctgatacattacaaatcacagctttcatctgtaattccattaccgccaaaactctatgcgttggtcatgtgcactgatgttatctcatttcatctttcttaacattatattaattatagccctaatgttataaataaaggtcagaaaggtttacagcttgtccaatgtcacaccgttgtaaatgtcagaagccaaatgtgaaccccaggtttatcctagtcgacagctcatcctatatcctgaaggatccccaatatacccttgtgtctcataactgcccctctaattcttacctcatctttcaaaattcacttcaaatgcctcttcttccatgaagccacctttaccctagagacactatgattctaaacacattcagtatttattatggctatttgttgtattattgtgcattatgtgttttattaacccagcaaaatccctggctggtcacagttgtatggaacttgactttgggttcccagatcatgagcgcttggaactgtgccttgaacagagtgaatgtttggtaaatatttgctaaactgaactggaaaggggtgttcatttgaattacaactacatctgctaccagatgcaaagcaaatgcttttactaatggttcattgcattagaatggttctaatgcaatggttcattgcattgcatacctctttgggaagtatctccagtttttccaagcatgtgtgataagattaaatacctcaagcagtgtatctgacatacaggagatactcaacaaataatagttttttattttatttttgttttatttcaagttaagaatgcggatggtaagagaagaatgtggaggggcataaattcagtataatatatagtctaatttggagatatcagagcaggtattgatggtaagtttttttgaaaaaagaaagatacaatgaagagttagaactcttgatttaaattctctgatttcctgcaaagcttctttacttactggctgggtaaaacttgagcaagttaccctctctgcatcccagatttttcatctgtaaaaacagggataataacagaatccacttatagagtggtagtgagaattatatgaaaaaaaaatccttgtaaaatacttagtatggtgcatgtcacacaccaagcactcaagttatagttgctactatcaccatcattactatcatcgtaaaaatcatttcataattcttaggaatctattcaaaggagaagacatttttttccacagactgtaaaatcctatagtggtatgtgtcaatgctgtcaaacacaaagatttatttctgctattgaattatggatgggagcaatgagttcatgcacttcatccaaatgatgcttactgaacgtctactttgcgccagagtcaggtggacaaatttatttgatttaaagaaggctaggaatgaaagaaacaaggggagccaggaaaaggtggagagttcagagagagacaaaaccacaagcagaaaacaaaggtagattcaatccagagacccatcagaggtcaaaatatcagcctgtcaaaaatcagaagggaagagtaaggccaagcagctcctgcataagaccccaatccaaatggcacaatgaattcaatcgctcatcaatcacagatcattttttggagatagaagaggggttattagacaacaggagagggacaatgagcaaggattttattttttatatattacacacctgtttttcactcacctgtcttttcatgtgaaggctagaaataatgaaaaataactgtgtatgttttaaaattcttaacttttctgattatcacaataacactgaaaggccaactggaaagtcctttctacatccaatgcctgtgccccacctcctttcccccacccagcattgatttgtgctatttaagagcagcttcacggagaattcaggcccatcctatgatcttatgagctgaccatagacaaaggaatgaagaatagtggagaaagccagggatcccgggacccaggacacacagtggacacagtcaactgcagtgccaagcaaaatggccaagattgctccttgctcggcataaaaaccccaaaggatactaaaagcttggcaaccttcaaaagcttctcttgcttcctgcatggggtgggggaagcagcttgcttagtgggaaaaaccatagcccagggtgaatccgctggctagattcatcaaagagatggctgagacagaacagatttttccttttcatataggaatgactcacgagcttgtttattcaaaaagttacatcctccatcaaagagaggtggtttactgggaagtgggatgataataataattgacgtttgtactggtcagcccactcacacctgtccctcgtgtctctgggcacagttacacaaacacaccaccaatgataagaaggtggccagtatatcttctttcattcttccttcattctgccacacaaataaagcaaacaatacagtgaccctcctttattttactcgtagtcattttagaaagggaatgtgcgttattggttcaagatgaggactggaagaaagactgcttgggttcaaattttgactctgcaaattgcaaaccgtgggaccctgaacaagtgacttaattgtcctgggcctctgtttctctgtctgtaaaagtggggataataatattacttatttcataaggttattgtgaggattaaattagttggtacatggaaaacagttcccggcacattgttagttctcagtaaatgtttgacattatcattattattacttcacagatggttaaatgttcttccattatggatcttcttttattcactattatcttaagaggttcaaattaaaccataaatgtaattaggtctttgggggaaaatataattgtcctatgaaaaacattttcttctcaggctagggagatattctggaacttttgaaaactctcctttaaataagaagattttataagtatggctgtgtgtttctgtatatctaaggaatcatcttttttataacgtgtatactggaagataggtctagacaaacagatgaatagatacatagataggtatttttctattttattaacctacttctcggcaattttcaaaactcatagcaaccgaagagcttgtcatttttcctcagtcctgtatttcaaaattcccaaaggcaaaccatcagaatgcattaataaattgttgtcttccataccctctgtgtctttcaaacttaaggatactagaacctgtaaatccattctctgacacatgaagaaaattaaccagttagtggattattttaactcctttcagcatgacaattacttattccacttttaatgaagatatgctaggttaattttggggggatttcactggtctatgaaattgttctcctacattaacccccccaaaaagaggaagaatgaaacaacataagtgcctacttatttccaaactctttactgtgttgtacaatataaatgaaacataatcagatctggctgggttcagcctgtctgtgattcatctcttgggtagttttactcactgggtaaaatgagaacgtcatccccagggcctggaatggtattgttgtatcctccccagccttcttcaacaccttgccatgtttcagggagggaccattttaaagctgattcaggggcagaggtagaagctagaaaataaaaaaaaattttgaaaatctaatccattgtgataacttccaaattctatccttattttaggatgctagtggtattttcacctcccaaagaagctgcctatcaatattttataagtttctgtacaaatatttatcagttaaaaagcaagtaattattcaatccttagattaccttcacttctgaaaaaaatcccacttttgttattatacatctgttttgccttataataaatatggcatgcttatcatgaaatatttaaaaaatgcaaataagaaaggtaataattgcccataatctcactaccttgcaataactaccttttatttctgtttccttccagaatttctcagaatttttacataattgagattatatcaaatcctgttcttattttttacacccagttctacttttgcttagcttagcctattttcctatgcattttataatattatttaaatgccttgtaaacataattttagtggctacatatcatattttaaaaatccataattaattcctaatgtctgacattgagactctttctattctctgttaaattgtaaataatgcagtgttaactgtctctatgcaaatttctcaataaccctgattatcttcttcaaatacattcctcaatggaatgactgagtcaaaggtgatgttcttcccacagctctccctacacattaaaggcggggtaataatctaaaaacttctcagggtggtaacttacagacagatcataccttccaaccagtttctattgattctgcctttgatcgtcaaacggcattttcttttcaaccattctgctagtatctcatcgcataattgaaatgtaaatctaataatttccaatggggactgtccaatagcacatcacgcacaacaccatgctgaaccatatctacttgttctttcctgggatgtgattactggtacagagttagaagggaagagagattgtctcaaaagggtagaatgaaaaggcctcctcttttgaggggagggagggaatcatgtccatgatttgctaattttacaacataaatagtgagcaccttctctattagaactgcccttaaaaagtagggatacaaaaagaaataacatgtcacccttgcctccaaggagctgatagtgttatatcagtattaggaggataaaaactctacacaggcactgaggggagttctttttaatggtacctgatcacgaaaggaagcaagattttgccaggagaagcttcccgagggaagtagtaactcagctgcattttaaagccttagaagttattcaggtaaaggggaggttgtgatgagtgtatgacaagagggttgcactgcagacagaaggatgagcatgagccgaggcaaaaattgggaagtcaagtggaggaatgataagaaatttggtgttgctgaaccacagagctagaagagaggtaagtgacaaggttggtaaaataaacagaggccagagtatgaaagataataaaggtggagggtccagagacttccagcacattaagacagaagtggatgaatagtttgtgccatagggcattcagggtatctctgtggtctccagatggagctatacagcaagcagtggaaaaatatgaattggaaagatgggaagagctctgagcccagagatgaatttggcatcatcggcctagaagctgtatttgaaactctgagggtggttgtaatagctccagaggatttcaaggtgacaagggaaaatacctgatatcagaaacatgaggaacacttagttattttttctaccagacccaattcctcagtagtcatggtttaattagagacccaggataacctaaaagtatatagattgtggtcaagcaaaaaccataggcaacttaattagtacaaaatataccacacaccttgggaataaggcaatgtcttggaataagcatcactcagtaagaggctttataaatatttcataaactccaatactgtaatacctttctaagttttttcccaatgttgcctgcttcccaacattagacccaaaatactcagctgggggtagagtaaggggtatttgtcagggtgacccctagcttgccccacaaagtccagataaaatgtctctgatgcctcatttccagtgatatttcaaacaagcaatgattgttctctaaaacctcacgccaagcttcaggaatctttagttactccaattttatatcacagatgatggaaacaaacattctgtacttttttcacctttactcttgcttataagagggctgacacagtctttagttggacaaattaggccttaaggtagctattctaatgaaggaatgttattatgtacaaatttaattattctataccatcctgcttaagataagaacactaagggataagaaaacatgtttcagtctcctgtcagagttatcagatttctatacaactaatatcagggttctatatgactattattgacaatcaaatttgtggagagaaaaagaagcctacaagagttaaagaagcagcagtcagagatctactgggagaatcagaagagaggaaggtcttggaatcctaagtaatacagcatctccagagagcacaagtgaccttgttaatagtagagttctggtaagagagagaattagaagtcactgttaaacttagcaatcaaggcatgggtgatccagatgacagtggtcccagttgagtggttgagacagaaaccatattacagtggattgaggaatgcactggaggtaaggaaggaaagatgttgggtcagaccatccaaaaagctcactgaggaatggacagtcttaagagttgagaaccacagcctttgatctgtcttctgaagctttagataaattagactagtttcaaaactggagcccatgaattttggtctggaccaacactcctgatgaggcctctccttgcttccctgtacaaatttgtccctcaacaagcacttaagattttaggtagtctcaagtctaatacatgagccaaatgttggcctccacacctttgctcttcatcaacccaggttttcatggctctgcatgaagaggaggctaggcttttgagaagtttgcaggacagctgtctgctaaaggaaaattcagtatccacaaatttgttttgtttttaaatgggaggcactgaacagaagaagccagtaaggaaagaaaggttaactacacgagacaatgagttgttcgctgatgggggaaagtgtggaagatgcaggaagggatgagttaactttgaacaagactagggctgcctgattctcagagatcaaagaaagcgacaaaaacttaggtctgtgggaaaatttaggaaaagaatacccgatgatctggatgttcttatatgaccatggacaatatgtgcacttagtacgggtacatattacatactcatatcggttaacacatagatagatggttaactcattcaaacattggattgacccattcaaacaatggaatgaatgagttaacacagatagatgtgttaactcattcattcattcattcttagttttggcaaaaacgatattgcaataattttactgttttacgtagagctactcattaaacaaaatacattaccatatttaaattttggcactagcacagatactacatacatgagaatcaggcaatgtcttgaaagtatgttatttaaaatttcctcctgatgaaggatattgtactaaatctgtaactctttgtgttttgaaatagttttctgttcccaactatatgaggtaggaaaactggctagattttaatataactcataaattaatctatgctcaataaggcaatttaaacacattagaggctacattgtatagcacaaggaacactgggctgagttgagacatctgagttcctatctaggctcatatgactgactactgatatgactaagtttaatatctgggcttcacatccccatttgtaaaatgaggcaactggataggatagcctgcaaggtctccacctttgttaaaacccacaactctatgaagtatgggctttctatttctcagcagttgtaattgacagttgtaatgcaagcatctccagttaaactgaccccttctaaaaagctctgaatgttccttccagagaatccttagtacagaaatcatcatactacatgctgagtgacatgccaccctgactacagatggttgaaccaagaatggccattcatagatggtccagtatccacagaagggggcctggcatgagagcttccccaacaggtgtgtcctctacagaataggcactgacacagcaaatcaaatctctccttggagaatttgaacatagaaactttcaaagaagagaaaactatccttttccttataacagtaatttttaaacaactgtattaattgattacttagtagtttgactgacatccccaagagatcataagaccccataaagtcaaagttcattccatcttgctcatcatggtatcccccacaccttgcataaaaggcactcaataaacaaggcattttgaaccacctaaaggcaaagagagatgaaggacaaggaacataaaaaacaaagtgtggtggcagctcagaaaacattctgaaaacaatcttgaatcacattcttcatagtccaataagcatggagtagtaaccttcaggattatcatttatagttttagtccagtcctcttacctcatttacctattaatttaaacagaggaattagatcattttctgattagcatgggctctgctctgacatagcacaaaaatgccactgaaaattaaaagaaatctctgcgtttgaaaagatttattcctcttgcaaatgtatagttaaattgactcagaataaacaaaaacaaacaatgaaatacatcagaaggtgcttaggagacatttagtttttgagaatttggctttttgagttagaaagatttcatagaaccatctgacttttgaggagggtttgtttaccctgatttcctgaaattaccaggaacaattaaagtttagagataccctgaatttttctttccatttggagggggcctaatagcccatctgcagatctggagtcctatgtgcacatatggtccataatttatgaaatgtgcttatttacatgtttcaattcttactttcattgctttgaaaaataaatccacctttatatccttttttgacatgcagatacatattttagttacagggcaacacaatagagagttatcagacatataagctttaggactgatacctgcctgtttattaacagtatgacaaggtggaatttgtagaactactggaggacattctgccatactagacacttctacttcgtgtgttaatactcacctgaaatagttgggggcataccttccttcacccggagaatgacttgaacttggccttcacctgaaactaaataccaaaagccacaacttgcatgtgatacaaagatcatcttaatattaaagacagtcacacgtgagaaaagaagaatttatgctaaattctagttgcctaaattttcaaaacagaaaaatgaaatccttgttagttaatctaacaattgatttccaacatttgattttgattgctttcatttgattaaatgtaattgcaatgaggtctccaggagaactggcacataaataattaggagaaacaaaaacagaaacgaaacctttagccatatgttctaaggaagccaatggtgtccagcagggcatatacctcatatcctattttctcttcatcattttgtaggctcagcttttagaattcatgtgtttttcaccaatagagttcagatcatccatgaaatgtatttggttacctttatccaaacaaattgtccttttaatgaagccttttccccaccccctatcctcctcctatcatccaagccaactgagcacatttaaaaggcctggggttcattaattttaagcgttcaataaattagtggaaataatcaaaaggcctgattctttctgataatgacaatttgatgtcaggataaaccagtagattaagctgggaacatatgctcctttgccaagagaggctgctataattaaatagtgaatgcatctacaaggtgctctcacgcctgattaattagtaatcaggtgcacaaactccatttttcagtcacaccttgtctcttattggttaattacctttctgccttattgtttgtcacatgagccacaccttccaccactggagcaccccttgttgctgaaggctgcagccttggggactcggccaaattcacattctccacttttgttttcctggaaccctaaaccctttcctccatcagatgaaataaacacaggatcattctttctaaatataaaacataagcagccaggcgctgtggctcatgcctgtaatcccagcactttgggaggctgaggtgggtggatcacttgaggtcaggagttcaagaccagcctggccaacatggtaaaacccatctctactaaaaacacaaaaactagccatgcgtactggtgcactcctataatcccagctactagggaagctgaggcaggagaattgcttgaaccctgcagtgtggaggttgcagtgagccaagatcacgccactgcactccagcctgggtgacagagcaagactctgtcttgaaaaaactaaaaaatgaaaaataaaaataaaatataagcctcagaatattacaaagaaaatgatccccaaagagatccatgatgagacctcttcaatttctctaatcttattttggtcattttctctttttaaaatttttctaaggatgtaaagcatgagtttgtgtctttctccttacactgccacatgttgagacctggtacaatgacaacatgctcttgacatgttctacctttatcaccacttccaagactttgcttaaattgttccttcaccctgttgcttatttcatgcatctttctaacttaatactaataataaagccaccagtcaaggtgtcatttcctttttttaaaataaggtctaactcatccacttctgttcacgttgatttgtgcattctctaaagttctaaagtacttctaaatccatcctgtgatattcatcccaaacttgttctcaatttaataaatatttattaagcaccaactgataatttaagatttcatcaataattagctttgtcttcaaatttttgagagagagatttttctcatgcaccttatgagaccagatattgctagaaatgtagatacttcattttcatgggccaatttagaaatcctaggtttaatcttgtatctgtagctctttccactacactgcaccaatggcttctggactgagtggtgaatgattttcttaaacctctacacacgcacaaatggtccctacctccaggagaactccctaccaaaacagacattgcaaaactaaaaaatatattgaaaatctgttgctcacttcattaacgttgagtgtgtgaatgccagtcagtgaagagaagtagtttcaggatcagaacagatacagaaaagttaacaaaagcaggaaaaattagaagtctgatttcctataccaccatctacatgcatctgggggcagatgagtatgagacagagggctatctcttcccaaacaccatttcctggtcatggtcatgacaatagtgaatggtgggaagaatgtgggtgctggagcccaacagcctgaatctgaatcctggctcttctggttcctagacatgggccactgacaagttatttgccatttctaaaccttattcatttcatctaaaagtgggaataatcatactatctatctcatatggctattagaaagaaaagatagaatagtccatggaacatgcttagcacagtgcctggcacatcatgaacaataaatgttaactattatcaatactgtcattatggcatgttcatgattccaggtgccagtcaacaaggttcaagaaacatgcttttactttctactctttttacagctgtatctaatcatgatgagctgtagtattacagagttgtaagcaacttaaccagatctgctaaagtttgttaagtgtgttgactctacaaagaactgtaaatgtgaagtgtcatttccaatttgaataaatacaaagagggatgaaaatcatttgagaatgaaggtattgacttgggaagagtttaaaagccttacacaagctgtgatattgtacatatgttttctcagtgcttatgatttctgattttgtatttgtaatatgagaatggttaatcttccgtgtttataaatggagccccattgtagttgatccttcccagattgtaagaagatctgatgctcaaaaagacaaaaaaaaagtctttgggccaattattgccaactttttctgacgagtgctatgtgatctaaacttgctataaacacagacatctagggtgaagaggaaatgtgctaagaaaatggctcctggtaagagaaaagagagttactaaagtagatgtgatacgaggtcctaccaggttaatgtgttgtgtctgaagaactctatcctcacttaaggctctaggaaacagaaaaattaattaattctctccctaaccaggtctaattctctcttgaaattttagagggagaaataagcacccatttatttaaaaataaaaaacacatggaatcttagtaggttatagactccttccctatttcactctttcattcatattctcattctcactttgtcgttttagtttatgcacatattaggacctctcactcaggccacatttatctagtgtgtcagccactgactaaacagtgaaagaacataaaacagcaactgcaatcagtgtctgcaaatgtcatgcagtcccaccctgactcatgacttctctttccgtctctgcctgccctggacccaagccccagctctgtcttcttgtgctggctgttggctctctctgcatttttacctcttacctccacaacctctctgttacctcctctgttgcctccacatcttttccctgtcctgactcacaaatctgtacactccttctattcctcctgtcctgctcagtgaatttgacctcattcctcagaagctgacctctttggcttagccacagagaaggcttgcttgtcagttagtccttggcagctaaagcttgatttacaggaccacactcctgtctgattccagcctcagaggcagccacggaaggcatcttggccctcataaaacatgatcctttaaaggcgttcacagaaatagtatatgaaaatcctgtgattacctttgagtcttctattatccctgtatcattcacttatgaaacagtgaattttgggggggacaaaaggaaaagaacttgatcaagacaccaacacatatatctgcattagccacaatcctgaaagttagctcaattaaaccttcttaattaactcagagaagaataacaattgttattctgactcagagcaatgtttttcatacttctgtggaggtatttgtgatttcccagaccctgccacagacctacacagcctgaatctctcaggagggtcctgggaataagcatttcagctgtttacacaggaggcaaaaaaacacaaatgtaaggaactaaacaaattttctcatactacactcttaaaatattgtttgttctcaggagcaggtgttcttaccaagtaaagagcgagacccagatggaaaagatccttacttcacaattcgtactttttatcaattataccaaacccttacagaccaaatcatattcccaagatgttaaatgcacaatggttactttagaggcataaaaagtttcattttagtatctatacattgtaaagtattttagaaaaaaacaactaacccattaaacccatgatttcatggatattattaagaaaagttaggttttaaaaataagacagtgtagaaattgatttaagaaaaatattaagtaaataatcagacaagaggtataaggatatgacacaattatgaaaatggtactaaaatatctaaagttcaggaagcacagtgttaactaagtattgttttttcttataaattgaaagaagaagagttggtttaaaaggttaggtatataagctcagatttaaaaaaagaaaagatggtatactagaaaaagcactgaacctagagtcagaaaagctatttgaatactggttgcaccacctatgacctgtgtgaattaaggctagcaactcagcattgcggagcattaactccttaacctgagtgattcctaaaagatgtatttgattctaagtttccttccctttcctttctcctcctctcctcttctctcctctcctctcctttccttccttttctccttctcttcctgccttttccttttggagttgtttccaaccaagaggcaaaatcccttttcacatccccagcctctgttctgttatctatatttttgccataaaggttagtgcagttccctgaagtcaattctctacatactggtaaaaatccttggggatctttgggaatgagtttttcataagaatgtaaattaatttattaactagaatgctgtggattgccttagaggggctcagcatgggaatggctgcagagttgcaaaaagattctgattccgctctgcctacaaaatcttccccaagaggtcacaggagccagctgacgccactctcctccttagatcctaaaggaattattttccaggatttgcaggcagtcttctaggccagctgaagaagagaagatttatgcaagcagcctgcttggctccagggcccttgttgcattgaggaaaggaaacctgggcagtggtagacaggatcaggagcctaggctccaacccaggaaagcactcctgattttttaggctctcccaaattaacagcatcttttctgacccatctttgtgatgagacagacctgagttcttctaggcaacttggcacacacaataaagtccatctgcctttccatgcacagccctcttgccctttattcgtggtgaggcggacatttggacacaagtgttggccagcctggctagacatgtcctttttttctcagtcagatcagaaggtggtggtgcagcaggagcctcagccttacaggcagaccttctcagctgccgcctcacacaatgtcccagctcggctgcatctctgctccatgagtgggggctgtgtgaactcgggagggcaactgtgaatggcacagcatctgatatgaatttatcaccggctgctggtcgggagggggatcaagctaggggaaggggctgtgtttaatgcaccctgccacaacccaacagtttgccctaaagagccttttaccaatataaaaggacagggtcaaaagtaagttgacccctgacagaatgtacaattattagaagaaggctgtgtgcgagcagctgctggaaccccactgactctgcatcgggcttccaagagtcagattatgaataatcaactcaagattgttttctccacccttctcaacctccccccgcctccctccaatcttctcctcctgttttgggcaagtcctattctatttctacaggaagaagcatagccctccctagcagctgcaataattgtgttcctattgtgatgaagacctcctcctggccacccccctacaagtggccattgtgagtggaaagtcagtgattatacgctccctctgatgctttgggggacccagctgcctaagtgctgacacaggagtgtgcagaaggccagggagggggctggtggaggtggaggcaagaggtgggggaaacccacgtctgtgagactggactctgacataccagaccttttgcataagtcaagccaagaacaaatgaggcattatcaggccccagtgttgagaggtctcatctccctttgaagtggagctgagcgtggggccaagcagcttttcctcctttggaccaagcaaacatccttcttttgatatgctacatgctcattatctctgccccatttaatgatttttgattgaagggtggcggctgggatgccgagaggatcgttagagaggctccatacagccaagcccataagaaaggctttccttgtgcctgggcctaaatttggaatttcttaacagtgtgcgcttgttcttagaggcagataaaggctgagcgtgaaattcttaattaagcaataaatagagagtggggtgtcagcagatgtagccagtagccatggcaacaggaatcacatgggcaagagagctgagactcgatgtaggcctcaggcctgggcctgactgacagctgaagaatcctacaaagcttgtaaaccagattaattagctgactaattatttcatagcgttaatgtaactaaaaaataaaaatagttcaccatgaactgaaacatccttggaaaaaaacagcagggaaagaggcagtgggaaactggctctgtaaggcaaagacatgagcagtcagggcatcaaatcgcatgaagggaaaaatgggcttgctggatttttctcccaactttgcaaatataaaagaacacttgttctacagtcatacccattcccaagcacggcatagaagctacagttgggatacacgataatagttcatcgtattcataattgtttatcacatcaaatattgctcctgcagcatcctaacacaaacaatagtgcacacaaggttcttcacttgtggtctgtttcataagtagctccttgggcaaaattctcagcagctttagaaaggcaacatgaaccaatctccctaacagatctttttaaatgagtgaggttatcttattctgtggctaacaattgcttaagtggcatcacatttcaatcacgggaacaatatatcatatatgtcatattatggtgaatcccatttatctcacaaaaatctagtaaaagaaaatagagggagaccctttcagaaaggttataacatatacactgagctcatgacacatggtattgttaatcttctaaaaagaaagaaaacttctagagaaatagtctatcaggaaaacgttggtgaaataacatggcacattaaccacacttgaatatatttggatgttttgtgccacaattccaagagacaagtaagtattttcttaaccttgctgtgtaaacaaagccactgaggcatggagcaattataatgcaatgccccaggtaaaataaccagccagccactgattaaaaccctaagccccaagcactggccatgagctttccaaaaaaactgcactccgtgaagatgtttgctgagcaaaggcaaaacttgccttggtagaaaagaaaaatgcaagggtcaaaacatattgtatgcgtatgatttttttctttgtcactgggaatccttgagaagggttctcccacaaccctgcctagcacccccgccatcctttctggtcagtgatccacaattatttagtgggcagcacactctagtggagagagccacagccaggagctagaatgcctgggttcaggttttttccactcagctgggttgaagatgagtcaggtatcttaaatcacacatgcagcagccaaacagaggaaatgaagataattgtgatttttctaaaacttcctatcctgggggaagtggtaaaacaatacaaaagatggcccacttagaagtggtcaaccagtgaatgaaaattcagccagttgtcagtgaagcagcactctgaaggaaatgccagccaagaaaaggagccacacccccaaaaaaatctaatatggaattccgtggccatgatagagatcaagcagcttccctacaataaaataaatttctgtatacacacatttcccatgtttttcatcccaggaatatgtccacatagactatgtggtcttgacttacaccatctgcatagattaaatgtattttatgtaaattatcccagtcatggtcctataaagtcaagtggtctgaaaaaaacagttaagtgaaagttacaatctaatcaatatataaaatgcatggcacagaactggaactctacttcttgggctcttgctcgggtaccaacaacagcaactaccattatggcattgggaaatgcagtcaggtatatggaaaacgtggaagcctaatcaccaccttgctaaagatcttataaactttacacagatgatatccaaaattacagctaaatttacacaacccagtatagctacatggcgcactgccatggaggagcagggtgagcctcagttcctgctgagtcctcataccatcactgtgacagcccagaaatgagaacagaagtggctctagccagctatccactccatacactcagaggataaaggaggcaccaatgaccataaaagatcctacggggaatcccttcaagaagcaagagtctccaagtttgttaaacattcaacaaatcctctgtgacttcttattccttttccaactcatattcaaaggaggagatactagggtattccaatacaaataatttttaaaaattaataaaggctatctacctaatagaagtgttttatactaagacattcatttatatcatacatatgcacagatacagatgtacctctacatataagcacacatgcacattcacacagctacttacacagatgtgcatttataccatatgtgtatatataatagtataacttgctattaattcaattaataatgctatcataagggaagaaaatctatagctgcatgatttaattttttttctttgtaccataaatggtttttattacgtttagtttatttgagtattcagattattttgcagttcatgaacagaatatgacctatggacaagacagcctcttcagaagcaggctaagtaatggaaagagagcaattcagattaaaattttgttccagaatacatatcaagtgaatagccataaagttaatggtaactatttactcttatttatggctgtattcggctgaagtggtaaaacaatctcaggaatctctgtccgtctcaagtttttatagttttaggttacatttatgaatggatcaaatcagaaataaaatttgaatggtataattcagtgcaaataaaatatacgacaatccttttggcaaagacataaaaaaagaccaagggagcaccagactctctctctgatgctattaaaatttaacagttctggggctagcctgtaggtccgactcactggacttatggttaggcacaagtgaaagaggcaaagggtggactcaggaccattgcctcgccctctaaatccatggccaccttgggcttgtggcaggggctagaacttgttatgctaataagatcccctggatttgaccaggatctactaagagcaatttataacaaaattgtcactcttgagacctatttagccagattctcctttttactgtaagaagtggcctcacagtgagctgcgattggaacaagcaggtaccatggtgctcagagagaccaatgctgacatggtatagaaaaggaatatgaaataaactccaggaaatcaaaagaagtggatggtcctgacacactggtatcctgagaaacatgcacagtaagaagataaggaaaaacctttggcctctgtgactctgcagtcacagtagggttcctgattacttcaacctcatgttaatcttgacgtaaaacagacacagcccacccctagtgctcatatcagccctccatgctactcatcttcctgacctcagattctcatcagaagttttccttctcaccttctacataaacttccgtcttaattcagcctctctctgcattggtactctctaccttggactctctactgttcctcataccaatggtcataatcagccatccatttttttctctttcttttttttatttttgagatggggtctcaatctcttgcccaggttgaagtgcagtggcatgctcatggctcactgcaggctcaacttcctgggctcaagctatcctcccacctcagcctcccaagtaactgagactacaggcatgcgccaccacacccagctaatttatttaattttttgtagagattaggtctcactctgttgtctaggctgatatcaaactcctggcctcaactgatcctcccaccttagccttccaagtagctgggaccacaggcacatgccaccatgcccagcattttttttttttttttttttttggagagatggggtctcactttgctgccctggctggtctcaaactcctagactaaagcacagccatccatctttacatgtgcagttgttccactacaaacaaatatgacactgccctaagatgaattaaagatattattagtactaactaccaatgtctagtaagcattttttgtgggctaggccttctgctcaagagttttacatgttattctttatttaatttcctatcctttgaggtaggccctatggtcatacttctctatagaggaggaggctgagccttagagaggctctgtgtatgctagctggtgagtgttggagctgggatttaaacccaggcaatcagacttcagggaacattcactcaaccataacacacagctgtccctttcagttcctcagcacttcacagcacaaatgtctggaattgaagggtgattggtgatttctgactatgtgctctcaaaacattcatccaattggatacttacccagataggtgagttgcctcagctggctattgaagaaccagtcacagccttggttctgacctggtgatggaagaaatggaaaagacagacccactcgactcccacatcttaggaggatgtcagggtaaggcggcaaatctgtgtgcaccagcagtaggtaattaccaggagcaaagttgtcaaaggttgctgagtacttgaagtgaaagaaaaacacaatagtgctcatttagtaaggaaccccatcattccacctactccaccacaccaccctgccaaaacaactacagagaacgcagatggagtagtttagaaatcatacaatttagacccagattgtacttttcttgtgggaaatgggaatacttaaatctacttcataaaaaattcataactagagctacaaaatcagactatgaagactgaaagatgccataaggttcatctcgtttaacaatctcaattaccagaggagaaagccaaggcccagacatatgaattgacacgtctcaggtcaaacagctagaagagacaaggccaggtctagaattcctttccagcttttcccacgacttgaagcgacaggcaatgataggcatgtcatccatttatcacagtaatagctaacattgtgggagcatttactatgcaatcagcactattcagtcctcgaaaggcacccctgtcattgttactcttactgtcccatttttacattgaggaaactgaggcaggcagaggttcagtagcttgccccatatcacaaagcagaagagtgcagtgtcaggacataaacctagggtatccacctccagaggcacaccctactgttttcactgcatgaaaattctccagagtgctctcacgggaatctcaaggcaagaaaagagaggcgtacatcctttctgaaagccatggagagaagatcaaaagtgattctgttctgaattcctcatgaccatggcagggcttctgtctccctaagataggctctcaggactgttagcaagaatgtgtatgataagataggaagaaatatatgtgttaaaagtatgaaaataagcttagggaattccactggattgctgtttaaaaatatggaaaaatgtacccactttcctcatggccatttttttttttttagtttttttttttatttcttctgaaaaaaaaaaaaacaggatacaggtgcagaacgtgcaggtttgttacacaggtatacgtgtgccatggtggtttgctgcacctattgacccatcctctaagttccctcccctcacctcctacccccaaacaggccctggtgagtgttgttcccctctccatgtccatgtgttctcaatgttcaactcccacttatgagtgagaacatgcagtgtttggttttctattcctgtgttagtttgctaacgatgatggcttctagcttcatccatgtccctgaaaaggacatgatctcattcctttttatggctgcatagtattccatgatgtgtatgtaccacattttctttatccagtctatcattgatgggcattttccatgtctttgctattgtaaatagtgtggcaataaacatacatgtgcatgtgtctttacagtagaataatttataatcctttgggtacataccctgcaatgggattgctgggtcaaatggtatttctggttctaggtccttgaggaattgccatactgtcttccacaatggttgaactaatttacattcccaccaacagtgtaaaagcgttcctgtttctccacagcctcaccagctttcattgtttcctgactttttaataattgccattctgactggcatgagatggtatctcatagcggttttgatgtgcatttctctgatgatcaatgatgttgagctttttttcatgtttgttggccgcgtaaatgtcttcttttgagaaatgtctgttcatatcctttgcccactttttgatggggttgtttgtctttttcttgtaaatatgtttaagttccttgtaaattctggatattagacttctgtcagatgggtagattgcagaaatattctcccattctgtaggttgcttgttcactctgatgatagtttcttttgctgtgcagaagctctttagtttaattagatcccatttgtcaatttttgcttttgttgcaattgcttttggcattttcgtcatgaagtctttgcctatgcctatgtcctggatggtattgcctaggttttcttctagggtttttatggttttgagtttttcatgtaagtctttaatccatcttgagttaatttttgtataacgtgtaaggaagaggttcagtttcagttttctgcatatggctacccagttttcccagcaccatttactgaataagagatcctttccccattgcttgtttttatgaggtttgtcaacgatctgatggttgtaaatgtgtggtgttatttctgaagtctctgttctgctccatcggtctatatgtctgttttggtaccagtaccatgctgttttggttactgtagacttgcagtatactttgaagtcaggtagtgtgatgcctccagctttgttcttttgcttaggattgtcttggctatacagggtcttcttcgattccatgtgaaatttaaaatgtttttttctaattctgtgaagaatgtcagtggtagtttgatgggaatagcattgaatctataaattactttgggcagtatagccattttcacgacattgattcttcctatccatgagcgtggaatgtctttccatttgtttgtgtcctctcttatttccttgagcagtggtttgtagttctccttgaagaggtccttcgcactgcttgttagctgtatacgtaggtattttattctctttgtagcaattgtgaataggagttcattcatgatttggctctctgcttgcctattgttggtgtaaaggaatgcttgtgatttttgaacattcattttgtatcctgagactttgaagctgaagttgcttatcagttcaagaaattttttgactgagatgatggggttttctaagtataaaatcatgtcatctgcaaagagagacaacttgacttcctctcttcctatttcaatgccctttatttctttctcttgcctgattacccggccagaacttccaatactatgttgaataagactggtgagacagggcatccttgtcttgtgctggttttcaaagggaatgcttctagctttggcccattcaatatgacatttgttgtgggttggtcataaatagctgttattattttgagatatgttccatcaatacctagcttactgagagcttttaacatgaagggatgttgaattttatcaaaggccctttctgcatctattgaaaaaaatcaagtggtttttgtctttggttctgtttatgtgacggattatgtttattgatttgtgtatgttgaaccagccttgcatcccagggatgaagccgacttgataatggtggataagttttttgatgtgttgctggatttggtttgccagtattttattgaggattttcacattgatgttcatcagggatattggcctgaaattttcttttttcattgtgtctcttcccagttttggtatcagaatgatgctggcttcataaaatgagttaaggaggagtccctccttttcaattgtttggaatagtttcagaaggaatggtaccagttcctctttgtacctctggtagaattcagctgtgaatccatctagtcctgggctttttttggttgtaggctattaattaggctattaattactgcctcaatttcaaggcttgttattggtctatttagggattcagcttcttcctggattagtcttggtagggtgtatgcatccaggaatttatccatttctcctagattttctagtttatttgcatagacatgtttatagtattctctgatggtagtttgtatttctgtggggtcagtggtgatatcccttttatcattttttattgtttctatttgactcttttctcttctttgttaatctagctagcggtctatctattttgttaattttttcaaaaaaccagctcctggattcgttgatttttttggagggttttttgtgtctataactccttcaattcttctccgatcttagttatttcttgtcttctgctggcttttggatttgtttgctcttgactctctagctcttttaattgtgatgttagggtatcgatttgagatctttctagctttctgatgtgggcatttagtgctataaatttccctcttaacactactttagctgtgtcccagagattctgatacattttctctttgttctgattggtttcaaagaacttctttctgtcttaatttcattatttacccaggagtcattcaggagcagattgttcaatttccatgaaattttgtggttttgagtgagtttcttaatcctgagttataatttgattgtactgtggtctgagagactgtttgttattatttcagttattttgcatttgctgaggagtgttttacttccaattatgtggtcgattttagattaagtgccatgtggctctgagaagaatgtatattctgttgatttgggatagagagttctgcagacgtctactaggtccactcgatccagagctgagttcaagtcctgcatatccttgttaattttctgtctcattgatctgtctaatactgacagtggggtattaaagtctcccactattattgtgtgggagtctaagtctctttgtaggtctctaagaacttgttttatcaatctgggtgctcctgtattgggggcatgtatatttagatagttagcgtttcttttcttgttgcattgttccctttaccattatgtaatacccttctttgtcttttttgatcattgttggtttaaagtttgttttatcagagactaggattgcaaaccctgtttttttttttttctttccatttgcttggtaagttttcctccatccctttattttgagcctgtgtgtgtctttgcacataagatgggtctcctgaatacagcacactgatgggtgcctgactccttatccaatttgccaatctgtgtcttttaattggggcatttagcccatttacatttaaggttagtattgttatgtgtgaatttgatcctgtcatcttgatataatttagttattttgcacactagtcaatgcagtttctttgtagtgtcattggtctttatattttggtgtgtttttatagtggctggtaccggtttttcctttccatatttagtgcttctttcagctcttgcagggcaggtctggtggtaacgaaatccctcaggatttgcttatctggaaaagattttatttttcttttgcttatgaaacttagtttggctggatatgaaattctgggttgaaaattcttttctttaagaatgttgaatattggcttccaatctccactggcttatagagtttctcctgagaagtctgctgttagtctgatgggcttccctttgtaggtgacctggcctttatctctggctgcctttaacagtttttccttcattttgaccttggacaatctgataattatatgttggtcttctcatggagttggggttggtcttctcatagagtgtcttaatggtgttctctgcatttcctgaatttgcatgttggcctgtcttgctaggttggggaacttctcctgaataatatcctgaagtgtgttttccagcttttttccattctccctgtctccttctggtactccaatcaatcataggttcagtctttttatgaaatcccatatttcttggagaccttgttcattcctttacattcttttttcttgtgtgcatgtcttatttcagtgaggtggtcttcaaactctgatatcctttcttttacttggtcaattcggctgttgatacttgtgtgtgcttcacaaaattctcatgctgtgttttttggctccatcaggtcgtttatattcctctctaaactggatattctagttagcaattcctctaactttttatcaaggttcttagcctctttgcattaggttagagcatgctcctttcactcattgtagttttttattacccatcttctgaagcctacgtctctcaattcatccatttgatcctccatccagttctgtgcccttgatggagaaatgttgtgatcatttggaggagaagaggcactctggcctttttggttttcagcattttctcgttgattctttttcatccttttgagcttgtctagttttggtctttgaggctgttgacccttggataggatttttgtgggggcctttttgttgtttttgttgttgttgatgctgttgttgtcgctttctgcttgtttgtttttctttcgggtccctcttctgttgggctgctgcagtttgctgggggttcacttcaggccctattcatctgatttgctcccatgcctggagatgtcactcaaggagacaggagtgcagcaaagatgggtgtctgttccttctgggacctctgacctcgaggggcaccaacctgatgccagtaggatcgctcctgtatagggtgtctgacaacctctgttggaggatctcacccagtttggtggcatgaggagcaggacccgttcaacaaagcactttgtcccttggtggagagggtgtgtttcactggggggaaacccactcgtctgggctgccgggattcctcagaactatcaggaggacaggccaagtctgctggtccacggagactgcagctacccactccccctggggctcagacccagggagatatgaattctgtcccggagcctctggctggagttattggagatcctgcggggaagccctgcctgcccactgaggaaggatgggtcagagttaggcccaaagaggcactctggctgcagacagccacagctggtatgttgggctgtggggacaagtcttgggacaaagccatccagcctccctggctccaacagggaaaaaacgcagcctagagctatagaaatgggtgctgcctttcccccatccacagagcttagcatgttaggcagttgcaagtcccagtgctggctgctgcctctcctgagctccaaactgggagctcaaatggcttagacagcaggcagctgcagccagtgctggtcgcccctccccgcgggagtttggtaggcttaagcagattccagctgagaggctgtaagaatctgcttagggctctaggcccgggtggtggtgtgggttcgcgagtgggatcttccgacccatgggttgcacaattccgtggaaaaagcagtttccccggctgggtagcggctcactcaccgcctcccttggctgtggggaacggagttccttttccccgtgtggctctcaggtgggccaccgcaccacactgctcttccttctctccgtgggtcacgccagccttctagtcaattttgataagagaacctggataccttggttgccgatgaaggcttcacatgcttattatgtttttgttttgttttttcgatggtagcctccgaacgtctctgtttctagtaagccatcttgccacacggccatttctatcttcactgctcttatttgtctcccttaacccaatccagcctggggactcatacagacttcgattggcaagttaatctttgaccacaaggtggcagtatgcaatgtataaatgctttggtaaggcattttctctggctacaaacacttctctctagggtaaattggctattgaccaataagttttaaagaaatgcaatgctataagatgtgtagaggttgtttctcattgtattaataaatttaaattttcaggcgtaaccattctgcattcacaataacacataaatagattctaaaattttcaagtttaaaaagcaaccaaatctcatatttagcttatattcatctggccaaaatactattgaagttttctttatctgcatcagaatatgccaagactttcaataacgagataacctgctcctctttcaacccattatctcaaacaaagaaagataagaacaaatgagaatgcagcataccaactaatggattccttgggttacctgcagagatctgttgatccaaaggttctcagattgcaatgagtaggtctcttggtccaagagcagagccatccagccacgagggttagacaatgtatcacgtacataattgacagtggttgttttatttctgctgtcagtcatggttaaatcataagaaacttcaggagtattcgctctaaggtgattttaaaaggaaaaaaaatgggttgagagattatttgctcattctgaatccaatacattcctctttcatcaattgcaatcatctttccattctctccacatatgtcttaggccctctttagttgtatgtctagggaggttttagcagtcactgtgtgagtgaaaacaacccagtgggaagttgccattggatcatttgcaaattacaatgtcctggtgaactggaggtggtgactctcaggttttttattttgtttgttttttgtttttctccttgagacggagtttcgctcttgttgcccatgctggagtgcaatgcgcagtctcagctcactgcaacctccaccactaataaatgtcacattaatgattttgtatgaaccaagactatatactatgattttaacaaagaaatgtctatggccagaattttgccttggaccagatttatcaacagcaaaaaacattattattggtaattggatattcacatgaggaacaattgacagaggcctgggacctgacatgcctaggtgctgagactctcagaagtcctgctcaaaatgcccagcaggagtggcttcagcatccttctctagaatgatgaggtaacctgctcctctcctgcagtcttgtgtaatgcctagtactcactgctattacagtacctatgtgttcttggctttgcctttttaaaaacatagattataagatccctaagttagaggtgttttcccctttcttattggtatcctctgccctggcacagggcccagcacacagtggcacccaaatcatgtttgttatatgaatgaacaatgcatagatgagatcttccaaaagcagccagtgacattttctaatgtatataaagttctatatatagaacgtataaaaacgttcagaagaactgcattttaccaaatgaggagactgaggcagggtagagcaaaagcaatatgtgagtatcacaaagtagaactcgaaatttgtgaatccagttacccaacttattctatacagccatcccagaaaatgatttttaagacttcattaaagcataagtagatttagccaatgattagacccctaaaagagagtgaaagtggacctaaagaaataaagcaaaatccaaaaaaaaaaaaaatcaatacacattatgactgttcttcctcctttggtttagttttcatgagaatctttaactgtggcattttgccgcaggcagataattaaattctcaaagtaagggaaatgagtcaaaagaggacattgggttttcacagtgagatggggcatgagtatatctaaagccaatttataagcccgtggaataattcaaaaaggaacttttttaagtgttgcacacttgggcactggaacaaatgggtaacaactgaaatctagattggcactcagtaggtgtgtaaacctgggcaaatttcagcacctatttaacctttagattcatttctttttaaaatggaggcaacaatagaatagatctcatataggtactatgaaacataaagataatctacataaagcactcaccaaggccaataacatctacttaggtctcatttaagaacctcaaatatgccagatttaccattctgcactacttatttgaatgcctagaggtttattcaggatattcggtcatttaaaaacataccaaaaacccttccatggtacagatcattgaccctggcaatgtagcacttgacacatatttcttgcaagattaaatgtatttgtttcatccatgaactaatgaaatgaaagggatgaaaaatgctcagggcatttgggaatgaaagaactattcttttttcagatttccctatgcagcattaactgaacctttagaaatcttgtgaggaggggaaaatgtcttcctttctttgggttttagatacttaggtttgttgtccacccttccccacccaccccttcaggatttaaattggaactaatggacaattctcaacctatattcttagaatcagaatgaacacaaagatcatctgttctaatttccaattcagtgcaggaattcccaccatatttcatccctccccttctttcagttatggggtgtttacatcttcgaatagaaaacattccatatatgggatttagttttaaattgtaatctttagaaaagctttagaatgttaaatttcccttcttagaatttctagccatttgcgctcagtcatcatggctctctcttcccctgatggaaaccatgagtcccataatcccaggatattttccaggaacaatttggcccaactatatttagcaaataaaaataagctttggggacataagtgtaaaacaaacatgataagaggtaagttcgaactaagaaatgtcaaaattggctacagtaggtactgtggtcagtaaataaaacacactagaaatatctaaatttcctcaagtacagggaatgattataagtgtttcaggttccaaaagtatatccttccagtttttactgagacatatgggcttggatttatttaaataaatcttgtgatttatttaaatcacaagacctaaatccaagagagactaattgataaatcagaatttttagttaatgattgaccataagaaataaaagtgcctttcatatagtgggagtttaacaaatattttctgactgaataaacaagtgttatatgcatcagaacactccagctggttatgcagtaacatttctccccaacttggaagtctacctagaaaaatcacatgagggtcaagagatttcctgcaaacttattttcaaaagaaatcagcagttgggtgatcctaagttattagagcttgatacaatcaaccccatatcagtaggatatttgccaagaggacaaacatagtcagtggtcagaaaacctctcctaggcacacacaagcaatgtgcactaataatggtctctggtctaggaaaatgctatgatttccttgaaaactcatatttctgcaatcctagtcaagtgctgtcaattaaaccactttttaaaaatagttttaactacaaaccaaaagaagatctctgttcaaaagcatccatctgttcacatttaattcctcctgcctcacctatcttctcatgcataccacgttgatcattaaaaaaaattacctcggccgggagcggtggcttatgcctgtaatcccagcactttgggacgccgaggcgggtggatcatgagatcaggagatcgagaccatcctggctaacacggtgaaaccccgtctgtactaaaaatacaaaaaattagctgggcgtggcagcatgcgcctgtagtcccagctactcgggaggctgaggcaggagaatggcgtgaacctgggaggcagagcctgtagtgagcagaaatcgcgccactgcactccagcctgggcaacagagcgagattccgtcccaaaaaaaaaaaaaaaaaattacctcaatatgtgatagtataatcaattgggtagatatttccagaaatattttttaattccagcaatgtggtcccaagaattcccctggtcaccttaactggacttaattgctcgtcaaatttcaattaacaccacatttacagaccaatttttaggatgttatttcccctgactcagtttctgtagattacaatttcaattattgaaggaagcatttttcagataatctccccagtttctgaaggcccatacaaatgtggtccctcttcaaatagtgtcaaactgctaaatgctagcaataatttggttctatttgtctttggaaacattgcaccttccttttgaggttcttctccttctagtcagaatccaataatctgatgcaaactccttggccaaccagagacataccatagcacactgtgatcctaaattactttcttatttctccttcatgcactgctcattctctcagagccttgagtctatcaagctcccctcacccatctcaaccaaggtttattagggatgcaatttcataggcactcatgtgcagcaccagctttctgtagtgcaatacaggtagagaaggaggttatcatatatactacacttttatcacagctgataggagagagggtcatatggtaagcattcagatatgctttccactctgaaaagcaactcaaaaagcaaaagacccatctcccatcaggcaagatggcttgtactgaccatcaccaggggccaaaaattcagtcaggtcatctcctgtcctcctaggccaaatgccagaattgaccatggaggggtcttctgaaaagcaccaaaagaacatcaagagtccaaaaaacaccatgaagagaacttaccaacaataattactacaattttcacttgccctaaatagccaccaatttccccatgccctaaatagccaccaatctcccactctttactgttaatgaagcaaaggagcacaaaagtatttctaatttggaggagccaagggagtctgcatgggccattagcagtagagagcttcattactaggggaagaagtctctccctgaacttctcatggctttatgtgcaagaaatcaggaggcaaccagtccattttaaatgttaacccttacctctgcatcagcaacagctcctcctgtctatgatcaaaaagacaaaagggctataagccttacatgttgtttttcttttctgtgggctgtcttaatgtttgttcttttttattttattttttattttattattattattatttgagatggagtttcactcttgttgcccaggctggagcacagtggcatgatctcggctcactgcaacctctgcctctcaggttcaagcaattctcctgcctcagactcctgagtagctgggattacaggcacccaccaccacacccagctaattttttatatttttagtacagatggggtttcaccatgttggccaggctggtctcgaactcctgacctcaggtgatccacccgcctcagcctcccaaagtgctgagattacaggcgtgagccaccatgcctggcccaaacctgtttttaattcagggaaatgttccattagaaatataacactatcacttggtaaaacttcctggtcaaagtaccaatttaccatactagttacttaaagagttatgtaacttagtgcccatgtactgtaaagaactgttgaatcccacaaaggatttgttaggcaatcaataataccaatgagagcagatattaactccctggtttttgtttaccattagcttacttttcctgagggtccatatctgtgtattaaagacaagcattgcacagagctctaaatgctcttgatttggaacagttgtgaaataaatcctctgtaattatccatctcctaagccagacacaccacaatacctaacctcaaattgtgttgcaaacatcttctgagtatttgtgcttgttgatgtcactctcatcttttactgcacaaaggggaagaaaaatcaaaactgtgggcacagccaacaaatttctgtggcatggttttgcatgagcatcctttaaaaatacaccatgctcataacaatccttgtcacagcaccactattctatctgctaacacctgccaccattccgtaatatttcattatcattgtatcattaagtttttccatccacagccttatggattcagaaacacttaaatatttctcctctaaggaagtatctacagtttttgcaacatagttatctgctgttatattaggacaatactttttgcccattctatcttaatatatgaagaaaagcaatagatgtccattatcctactttaggtgaccatataccattgcatctctacttttgatctgctgagtccaattggaatggctatttgagaacacgagaacactgttattgaagctatgcaaccagaaggtagacaggtggacaactgcttgtcagggatattgaaaaatattttatccagcaggtaggaagttagactaagaagcttgtcctcccatatatatgcataccagagctgtgatggggatgactgacactggctggcagaagcccatcattgacccttcttcccaactatatgttcagtgcttttaggttggaagcttaaaataaggcatgtgagagtattttcactatagaattaggcaaatgaaataaaccagagctttttattctggagagctagttgttaaacatttaccagcataccactgcaaccttttattattcataaaacttaataaccatgtaatattgttgatgatattcctcagtttggggtccattgtgatttttagatctttttctactttaattctgtaacctttgctgccaagaaaagataatacatctttgaattttcttgtctcacagggttgttttttaaggactgaaaagataccattagtgatgccatgcctatttatccctaggaaggaaagtcaagcgattattagaggaaaaggtaggccaaaatttccatttgaactcttctttatttttgcattcacagaggcagggggtgactcgtactttgaacactgacaccttaagagtggttacataggtaaaaactgaacgcaagcactacaggagaggatattaagcaagatctaagaatcaaggtgatcaacaagaacactaaccttttattttccaggagaggtgggaaggaagaaacagaaggtactggggcacgatgaatcaaagtcaacgccctgaatgacctgaggttctacaaccacctgggaggttttgctgggtcagtacaacgtcatatgattattacaaattattccctatttttcaggaattggattaagttacattacctaattcccttgccaggcatttgtttctcagaaacaaaaaattctgcagtaacctattcaattagtattatgcctatgcgttgttttgtaaatcacaaatgtaaaatagatattctttaaagagtacctactacatgtcaagcaatgaccctgagggataaataccattatacccattttagtgatgaaagaactgaaacaaaaagcggtaaagtaacttgtgcaaagaaatatacctaggaagtagaggggatatgacttgtacccacaaaggattgttaattacttctctattcttcagtctgaaaaataatttcaaacatgtactgtatatatgtcttgactattttatgtacgtcctgtaaaaactcagaaggactggtcagccaacctacaaaatcttgcaagctcttctaatctccctcacactcaatacagtcaaaaattcgaagacagaatcaaggtctgatctgttgatatctcaatgagtctacgacaagtgaagaagttatacattgctgtaaacaacaatgacaaaaattttcgagaaaataattataagggttgagcttacatcctctctatcacagttttatgtacctattccaccaggacaagaaaacaattacaaataaaggcaaactgatgattgaatgggggtagagaggggttggatagagaaggaatcagcaattagaataaatcctccagtcaaatgattgccccaggaaagtaaaagcccagagaagattatgaaagaagattcttaaatactagatattcctaggaattttagaagactggagatagcattttactcctgggtcttctgaagaaaagccgaatgctgtggactcctcatgaacatgtcctaggagagaaatagacaataaggacactaaaggaagatctgggggcagtccactattttttatttatatttttttactcaacaccaattttgttgagttgctatgtgttaaacagagtttggggcatcataatacaaagaaaatccctatttgccctccttgccatttataaggacagacggacaatttagaaagctatgcaggtgctataagtactgattagagcaagtataaagagctagcacacaacagagatatcaaaacctgcgcagcatgctcagggaagcctagcagagaaaacgacctctatgctgagttcatggaagctgaacattatgaattgaagagcacaaataagttgaatgtggctaagggacagaatgcaggaaaggtagagcagagtgctgagagataatgctggaacccaaagcagacagcaggacacggaagctccatgacacattaggaatgtcagactttccttggaaagcactgagaattctttaaaagtttcacgcaagggaatggatggcaagatcagatctgcatttagaaagttcagagattgaaacaccgaaaaatggcaagctaagtggctgttgtggttctacaggtgaaaagtaatggtagcccagactggagaaggatttggggaaggagagtagtagaaagactcaaaagggatttattaaggaggaaaattgagctgataggtgattagtgtgggaaataaggtacaaagatgagtcaaggatgactccatgtttcaggtttagaccagcatttgcctcagtgggattctgagcacccagagagaaacaggtctacagaaaaaaatcataaatcccattttggcaagttgagttttagagtagccacactaaaaagctcaaaataaacaagttaaattaattttagtaatatatttagcccaatctatccaaaatattatttcaacatgatcaatataaacaaattattgagatattttacattctttttttcatattaagtcttatctatatggtgggtaattcactcttacggcacatcacaatttggactagggagatctaaaaagagcacacaaaatcctactgataatattgtacttgtttcgtgtaattatttctatacagaaaaaaaaaatgtttacctaaagtttgggatagataaatccaagaactatgtgggacattttataattatgggaccctggagaaaaactgtcactggcatgtgtttctgatatgaggtcctgacttacattggcagaactaacactacccctgtctcaccaggaacactgaggttcatagggggaagctggtagaaacagaagctgggaaaggaacgctatccagaatacctgcggcttctacagaaagcatgttttcagagctgatgagagagaaaacaatataagcagcactcacgcagatcaagcatgctgtcattttaacaaaacataaactagactctgccttgtagagtggcagttttttcttcacccaaatattaaatagtgtggccaacttcaaatatttaaatacttctgtcatcccaactgctggctttgagtcataggaaccaataaagtaggaagtgccacaaaggtaagcaccgtcagatttaaggcagtgagggacaggaacagaaggttgccaatgtcaaacaaataacttatagtgaaaatggaccagagagggggcctaccaaggaagaactcacactccaagagcttggttcttagcagaacaggaagaggatgtcttgtttatgcagctatgtaaagcctcactccctgccctctctggacctcttactgagggagggagttaagggttgaaagtgaagacagcagggtgcttatgccatattagatctccatcaacatgcaaccccaaaagatcataactgtgagagctttgtaaatcaactcttagggtgcttgccccagggcaaatagcacaacaaattaatcctttctccatgaaatgcagcaaagtttgcatctatgctgaattcaaattgctcattagctctgacatgttcctaatgaggttataatgctttgggacaaagatcaagccactgagcacaaatagctagggatagaatcatagaaagataaaattagaaggaccttagaggagtgcctctcagactttaataccaatcacctgggcattgtaattcaggacatctggggcccagtctgagagtctgcatttctaaaaaaaatccctggtgctgctgctgctgctggtccatggacaacattttgagcagcaagaccttagagatcatctaattcagttgcctctcctagaggtgagcacatcagggccaagagatttataactggaagcacgctgagacttccaggtgactaattagggtcagttgagtatttgtccatagacctgtgagtcaacctgaaaattttaaatagaatctaaggagtagagtgaccaatcagcctagatgactgaggaagtttccagaacatggaatttgcctttttaaaacaagaaaaaaatccaggaaaaccaggataagtttttcatcctgctagacccttttgaatctacttagaacacagtatcagtattacatttttcttgaccttgtcagtccccaagtggtgggatcatgacctgccaaggcaagtaccttaatatcctgtcccaaagatctcaaagagcaaatgctcaaacaagtttcaggcactacagagccttctaacatcacattgacaagtgcctctccaagagacagcctaccagtagatctcaaagtaaagcatgataaaggactatcaggaacacgcagaaataaatattatagaagcatataatgttccttttaagtacacaaatctattttcctcatttgataaaatgcatgtaagaaataaatcactaatttttataactctcaaaacactcatttaaaacatccttggtaaaaacactaaaataataaaaatcaggctgcatccctgagaatgaagaaaaagtcatgctctgcacaatcaaaatgattagaaataaaaatatatccctacatattattattttactcactggaattgggctcattaacgtcaggtagaataatgaatgtctagaaagcaaaaatgaaaaatttccagactattcagtgctaccagtgcatcgctaaggcttctaaaacagaatgccaaagcactgattccacatgcattcaaaatacagagttagtgcaatcctaaccacaatgattctcactccctgaagtttacttgttcaagtaagaggccaatgaggtctgactgaattacttgacttaatactcatggagttaggacacttaagacaaaggaagaaaataagtgtggctaaatatatacaatgcatttggaataagtaaaagacagaaccctagacattcagcaatcattacctggaaattaaagagggcaggagcaatcctattatgcattataaacagccccgctgctgacttaatggtagtttgagtagcataaccaaggagtccttgctccaatattaataggaaatgtattgtaggaatccaatagttcatgaaattaacaaggaaaatgaactggagtgaagcaaccttgcaagtaataggaggcatcagcaattgcttccctggagcatattgaacacttaaaaagagcttgggaagagtacatgtatataaatgagaatggacatttttagaattttttaataatacttttaatttaaatatatttcaaactctctgttggctgtaagtctttctaagaagaagttattagcccaaaatgtcaatgagaggtcacaagctatgagatctggtccaaagatattgctagttagctgccatttgagtcagcttaaaactaccatacactcatgattcagcagctgtcaaaattattcccatttcacttctttagagctaaatacttcaaataatctagaaaacaatttcccttctataagcctcgacagccagaataacagatgcatgcccatcggcaagctaaaaagtatagttaattccacttacaaaccaatagacatacgatgaaaaagaacacctcctccacaggcactgccatggacaacccgaccaaagcttgaattgaccaaacaagaagctgaaagggtttccatagaagcaagaatgtgacttctgtttttcccagacagagacccatccaagtcttccaaaattgctgcatgaggaaatggaaatgccactaagtttgaagagtttgtaaacttcaactggctggtcttcacagtaaatccacctataaattggaaaacagaaagattattacacaatggcacaaatagcaactaaattcactggagtgatggtcttaggatttaaattgcatatttatctagttttacaattcacctattcatgcaagaaaaaaagtgttttctgtgggtgttttacagtgagtgtttactgtctaccaagctctggtgtgctagagatactaagaggtataactgcagcattggccctaccttcatgcagtctatagtccacattgtagggcagtgatttttctatcatggttgattttaccttccaagagacatggcactattttcaatcatttttggctgtcacaattggggagctggcagtgctactggcagctagtaggtagaaaccagagatgctgctaaatatcctacaatgcacaggacaatccccacaacaaagaattatctcacccaaaatgccaatagtgccaagggtaagaaactctggtctagtgggaaatagaagcagaaaacattaatttattaattactaagcaccaaagatgctatggtttagtcttccaatctttcagctttcattcctctgtggtgagtctaacccctccaatacctcttactataaggtttatttaaacatttactttcaaaagcaaactcaattaatcacttgggcaaatagtattagtaatacactttctaagtattagctgtagggccacacttcttggcagtctttccccaacaccactgccatgtgactcattggtactatcagtccaattgcctaaaaggaaagtatggcagtgatcttctaattcacacacccatgtcattaaaggaagaaaactaagtacacatctcccagtacacatactaccataccataatatattatgtacattataaaatataaaaaaaagaaaataaaatgaaaaagatacaaatagaggctctaatgttttcattctgcagcccaatagagtacatgcagtgaattgattcatacatgaaaggctacacaattgcacctcttgcaacttctgtatttcatttgataccacaaaccacctgcagctctacatttcagtcatactggacttctttgtgatttcccaagcacaacttacttcttggattctattttttgtgtgtatactgttcctagaaattcttccttgcatataccttcttgcaaacttctattcaccttcctaaaccctactcaagaataacctctatgagctcttgcctgacccccttcctcggccccttcactgactttgttgagtcctctattactgcgttcatcatgctctcttacaataataggcttggacatttattttagtgcctagatcaagagttcctggaggacagaaactatgtgttttttatatttgtaccccctaggtccttaagcagagcctgaaatagatggtatttaagcaaatgaaaagaggggttagccaatactattcagtgaaaagggattagagttcataggagtagtgtgattttttttcactgtctcatgaatgatatgaaatagtcaagatattaaagaattgaggaattgcgattgcaagcacttgttatgaggcatttttatttctattattatttctacaatcctaaactcagatgccacccaaataaaaacaatctttcattctgcctacataggaaaaaaaagtaaagtggagacttgttgattattcatttaattaaaaaaacaaacaattatctaaattggtgattcaaaccacaagagcatatttacttaaattacttggtttggctgtttacgatgatcaaatcaactagattactctctacctctttcaccttggcccatgagtcctccaagttatttcttaccacctctgagatgtggttaaaaagtgagcaagaactcctatgtttccctttgtgcatacatcaagccctggactgttgaaaacattaagtacctgaactttggctccttcaggaaaggctgtatgcatgttagtttataccaggtatctacccatctaactccattctttcatttaatcaataaactgcctactaggcatctggctctgtgctagctactaataattaaaactctgagcaagaaatacatgatctctgcctttatgaaggtcagagtccagcagagacataggaccataatgatagaatgtgataggcaccataataggagcaggacagggagctgcagaagctgtactgggagaacctccaggatgtcttttaggagatttaagcaacagtttctactgatgcaatcttataactgaaagagataatgattcacaaagtatttgccactatttataatactgacttgaatatgggccttatttatcatctgttctgtctattcaaataattaccttgtccttgggaacagtctgaacaggttctaatggccacacagttgatgagatcaaaattaacaaaggttgtgttagacaccatcagttcccatcttttaggagttttaatcccagatgacatacacagacttccctgtgatttaaaagaaaaaaagatgaaagcaaaataagaaaactggacacatgaaatacaattcataatgcatgaataaaaacaaagataaaaaagcgagctattgactaagagaaaatatttgccaatcacacatatgacaaaggacctatatccagaatatagaaagaactcttaggtttcaacagcaagaaaatagacaacgcaattcaaaaatcaggaaaaaaaaaccttcaaaagataacccagaaaagaaaatatacagatagcaaataagcacagaaaaaaaaaatgttcaacatcattattcactagggaaatgcaaattaagatcacactaaaatatactatgcacctattgaatgaataaataaaaatacagtgacaatagtaagtgctgatgaggatgagaaagtattaaaactctcctgtttctagtggaatgcaaaatgagacagccactgtggaaaactttggcagtttcttataaagttaaatatgcccttatcatatgacctagcaattcaactcctaggtatttaccttggagaaatgaaaacttacatttatataaaaacctgagacaaatgttcataacagttccatttataatcaccaaatatggaaacaagtcaagtgcacctcaataaatgaatggattaacaaactgcattacatctatctaatggaatactattcgtcgataataaggaatgtaatattgatatgtgcaacaagttagatgaatcccaatggcattcaggagtgaaggaagccagtcccaaaaggttacatactatatgactccatttatatgactgttgaaaaggcaaaactatagtgacagagaatatattagtgattgccagtggtttaaagcaagaggaggctgtggctacaaagatggagcaaggaactggggtggatgcaactgttctgtgtcttgattgtcgtggtggttgttacacaaatgtgtacatgtgttaaagctcatagaactgtacatcaaaaagtcagttttgctgtatattaatatattttaaaaactttaacaaaaagtctgaaaagaaagaaacaataagtgttttcatgattttccacaaaatctctttgacaaacactatccaatcaagctgctagtgcctcactgttccattgttaaaaatagtcttacatttgaggattaccagaatttttgcaatcactcccaacatgaaaaatgatgaaacaataaacaaatagcagaaaagaaactcagtggacacaaagctagtctagaaatcagaagaaaacaaaaactataattaatggccttggagaaataagtatattatatccatgaaacaaatagaagcctaaaatattatttttagaaaaaaaaggaaataggagagtagaaaaaaggaattcaatatcatagaaagtagaacaaaaagacaaagagatggaaaatcagtaagaacattaagatgagaaaaacattccaggaggcccaatatttaaataatcatagctttaaggaaaagaggaaaacataggggaaagaattatcaaagaaataattgaagaatactgtgcagaaggaaaggatataattttccagactgaaaagtcccactcagtatctagcacaatgtttagaaaaagagccacagcaaagtgcatcatattgaaattgcaaaacaccagggacaaggacaagttcctaagagctttcagagagaaaaaaaataagttacgtacaaaaatcctggaatctgagtttttgttttttggtttttttttttgagacagaatctcactctgttgcacagtctgcagtgcagtggcatgatctcggctcactgcaacctctgcttcctgggttgaagtgattctcctacttcagcctcccgagtagctgggactacaggtgcttgccaccacatctggctaatttttgtacttttagtagagacagggttttgccatgttggccaggcaggtctccaacccctgacctcaggtgatctgcacacctcggcctcccaaactgctgggattacaggtgtgagccactgaatctgagtatcttaaaactattcagcctcaagaccagaaggagctacaagatgatggaatattgccttcaaaatttcaatgcaaaatgaacttcaacctggtatcctgtaaccaacaatctactaataaaggggtctccatatatagctcagaactttcaccttccatcgtttccttttttttttttttttttttttttcagaaagttaccttagggtatgttcaaacaaaatgaggaattaagccagaaaagaagaagatgtacgaatcagaaacaagagttccaatactagacagacatgaaggaaatctccaggataatgttcaagggagattctaagatggagctttgaaacccttcttatacattgctggtgtaagcataaactctggattgttgcttggcattatccactaaagttacacgatgatccagcaattttacaacttggcttatattcaacagaaatgcatgcacatgaagaccagaaggcatatagaataatgcttatagcattattatttgtaaataaccaaacttacaaatgatgaaaacaaccaggtacaataagttacatgctttatgattccatttagaccaacttaaaaaacaggagaaattaatctatatcgatagaaggctgaataatgcttgccctttggctagggcgtgcggagtggggttgaatggggggacaagaagaggctttagaggagctgataatgttcatttatttattattagtttttattttttagagacaggatcttgctctggcaatgttctatttcttgttcttagttgtatacatatacatggttggtttgctttgtaaaaatccactgagctattcccctatgatttgtgcacatttctccataaatgttatatttccatgaaacatttaccttaaaaagtaggacaaatactagagaaaggtaacatagaagatgagagggtaaggaaagaagctaaaggagtttaatgtccttgcattacttatgtaaagtttaacagtgctgatgtaatttagactttgttaagacaagcaggcacattaaaaacttaaggccaatagctaaaataatcataacagaatggataactttcaaatgagtaaatataaaaatatgcaacacaagacaaatcaaaatagaaaagaagaaaaaaacagaaaccaaaaacggattgcaaattgaaagtgcaaaataagatggtagaaataaatgcaaatatatgggagacatcagcatgtggaaggtaattgaaaccactagagaaaatgagatttctcccagggagagctagtatattgagaagaaaaggggccctacaacagaatttagggaaacaaaaagatgaaaggtctaaattgaagaagacaaatccacaagtgaaaatgggaaatcacccctagagaaataggaggaagaatgaagcaactccatcagcatctgtctgaatacggtattttttaaagtagcatcatctgctcaaattaattacaataacaacgaagacagccatcctacagatacttcgataagtagggtgaccgtaatttaaattaaaattagacattttttttagtgtgaaagggtatgttaattagacagaatgctgggacaataggtataaacaaactacgcacccaaactaggatatatcgtcatgctatatagcacatgtctttcttgtatatttaagtcattcgtactgaaaattattctattcatctcaatacaaaggtaacattggctgtgagagtaccaacacacgtacaggtatgcttaaaggaaaaaaattccttctgatgataaaaagttcttccagaaagtaatgtttattttaggatgtgactcacagataattgtatgccaccaattatatatgagtggaaagtctaacaatggacaggccaaattctttaaaagtcttaattcctggccaggcgcagtggctcacgcctgtaatcccagcactatgggaggccaaggcgggcggatcacgaggtcaggagattgagaccatcctggctaacatgttgaaactccgtctgtactaaaaacacaaaaaatgagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccaaatattgcgcttttcagaccggcttaagaaacggcgcaccacgagactatatcccacacctggctcagagggtcctacgcccacggaatctcgctgattgctagcacagcagtctgagatcaaacggcaaggcggcaacgaggctgtgggaggggcgcccgccattgcccaggcttgcttaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaggaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtgaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatcaacagaactctccaccccaaatcaacagagtatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactccatggaaactgaacaacctgctcctgaatgactactgggtacataacgaaatgaaggcagaaataaagatgttctttgaaaccaacaagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataacgaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacatagccaaagacaaaaaccacatgattatctcaatagacgcagaaaaagcctttgacaaaattcaacaacccttcatgctaaaaactcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaaaaacagacaaacagagagccaactcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatgggtaggaagaatcaatatcgtgaaaatggccatactgcccaaggtaatttacagattcaatgccatccccttcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaggctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaaggtctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagcaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaattaaaaaaaaaaaaaaaaaaaaaaaaaaaacacaaaaaattagccaggcgtggtggcaggtgcctgtggtcccagctactcaggaggctgaggcaggagaatggcgtgaacccgggaggcggagcttgcagtgagccaagatcgcgccactgcactccagcctgggcgacagagcgagactccgtctcaaaaaaaaaaaaaagaaagtgttaattcctaaaggaatggcaggcacaaaagacagaggctaaaatcagagtcccataaccacagaggtcaggaaccctctttttctttctttttttttttttttttctttttttggaacaactgacacctggcaacatagtggttcccaaataaatctgaaaaatactgtgctaagtaaagattaatagatttttttttgcttgttcactttaatgctagaatttctcagagcctttagtgtattttttcaatgaattttattctgtatatttgagatttacaacatattacagggtacacataggttatagtgaagcaaatcaacatatctattatctcacagttacttttctgtgacaagagcagccaaaatccacttatttaacaaaattccctgacacaatacaattttattatctctaatgcttatgttgtacattacatctctggatttgttggagattttgggaaatagagggtacggtaaacagcacagtataaatataattataaccaaataatcttctctttccagacactatctaagggctagcttttcatgaaaaacacttcagggaacattggtatgaacactaataaatgtcctttgccaaagccattttccatgtgcaattgaagaatatttgaccaggagtgggaggatatcagggtggtcctagctccacaatactaggcatgaaccttaaactgccattcaagtttccaagcctccattttcccctaagttcaagaagttaaccagatcatctcttaggtaatagttggctctttaattatgtggttttatgatttggataactaaccagcatctagacatcccctagaacaaaactgtttaacattttccaccaggggactcttgtcctgcacttacttaagagactgaaaggccctcagctgtactacattcctagtgaattacaccccaagggtgtgattatttttgattatctcatgatagccacccttttgtcataatttacatcttaatttttgtcactttcccattaattatgatgtctatttaacatcaattaagatactgcaacattaatttaccaagacagttactcagtttgctgggaattttgtttttaacatctactctaaggttatttctggaaaagttaaggacctctgatgtaccacagcatcacagaatctaaatctgggtaccatcctctcttgaaaactacacagtctgaaaggaagaatcatctctcaaggtggtaatccttttagagggaaaaaaaaactggcacttatttatctcctgaaaagtatagttcaaaggagattttactaagaaaagttgagagttaaatccaggaaaatgtagctcaataagaaaatgacttttaaaatcttcacatttttatctatagctgtgaaataaataatcttcaatggaagtataagaatcaaaacttatcatttaaatttcaattgaactaagcactcaggaacaaactgaagagaatattcttccttggctcccaataaatctatgatttccataatgatgtgatgactagtatgaatgtagttctaataaaaacaagaacataggggatccattatagacctgaagcctaagagaccaatggcagccaggaacccccacttaggaactagtgcttcccacccgggagtactctttgccccatctgcatccttgtaccctgagaagtcatctagagtctgatttttatcatgtggaaatccatacttaggcacatattagtgaatcacatacaaaataacgaactaggcaaatttctatttcatgatttgacctcttactatgagtaataattctaaattgcaaccaaataaaattctgtcagctacttatgacttctgtgatttatctgtactcataacactaaagcactgtgtatatatgagttctattatcaatatcaccactattacaaataaaaaggtcttttaacttttactaattaaatatgagattcactaaagaatgctattaaaattgcatatcctggatcatcagggggcccagcacatgtaattttgttgtgattgacagcctaaaacaaccacactaaggcacttaccttgtgggcaaaatgaccaagtaataagctgtcagtaactgaagtatttgcatcactttccaagacgtcaattccaaaatctctgcatgaataaactttgaagtttttcaggcgaagattgctacttctaaaaatctataaaatacagcatgttacagcaaaggtctgaggcttggtttttcttgcggacttcctgtagcttttaaaattattgattaagtagaaagaagcatgctatattgtattaaagcaccttttgtccatcaatgtcagtataggcatcctcaagttgctgtgaggtcagcactaatgagtctcctttggtaacacccctttgtacttttcatttctcctcataataaccaatacattaaaaagatcaatatgaattctccacatatctaaaataaacttggagtggccaaatcacacaaaggtaacagagaaaaacattgcatccaagaactctagtgcttaacattttcttcaatgtattatatattaactcatactgtcagaagattgcaaatatgaaataagcagctcagcatgactacagagtcactgtttgtaatttcaacataagttatgtacatatatgtttatgataacccaaacaggggtcatataataacaaaattagcttggtagagttgtaagtctactacttgctatggtttaagcctgtccccgaaaaagcatgttttggaagcttaatccctgatataacagtgttaggaggtgtgtaggttatgaatggattagtgctgattacaaaaaaaacttggggctgtgagttctatcacttgctccttctttgacttctttgcccttctgctatagactgatgcagcaagaaggtcctcagaagatgctggcctctcaatcttggacttccaagcctccagaatcatgagctaataaatttctgtttattataattttcccaaattttattattctgttatagcagcacaaaagggactaagacaccactggtctgggagacagagttgtgcttatgtttacgtctttgaccaattttttgctaattttatttattattaatacataatgactcatttgaagttaatttttgtaagtagcataaattaaggtaggatacaacttaattcttttgtgtgtgaccatctagttatacaagcaccatttgttgaaaagactatatttcccacattgaatggtcttggcatcctttgtcaaaaatcatttgtttatagatatatgggtttatctccagactctcacttctatttcattgacatatatatctatctttgtgcccatataccacactgtcttgattattgttgctttgtagcaagttttaaaatagggaaggataaatcctcttacttcattcttcttttttggtatagttcgagggaagtttacgttttaaatttgctgctattatgttacttaattttccccttattcttcactataaaagtgcaattccaagaatatttttattatttaaactttttgattaatcaaatttgagtgcacaagagttcaagttgtagttctgtatttttttccttcataggtttagcatttctgattgcagaatttcaaaaaatggctttattagcatcttttaatattttcattttactagattatttcctctagaaccaggctactcaagagcagggagacagagtttaagcccctgcaggtataaatcacttctctgcataagagggcactcaacaaatgtttccactagatttgttacccctatagggtatatttatagtgctcatgggaagcattttataaaattaaatgagaacaaaatactaaatacatttcggactccacctgttagctgtcctaattgtatatttttgggctttcttcatccacagttatctttcttttatgggatatatgaaacaaatgtttgactttcttattgtgacattattatatgtttgtattctatttcctgaaggctctacaaacatagttcttcacctatatatcttatgttccagatttctaggcagagacaaagtgtatgtaattttgtctgtattgcatcaaatagtgaccctgaataatttttacatgttgctgttagcagtgagcatgcaaagcttccttataagaaaatcattgggataatgaagagtaaatgattgaacatgaaccttttcttttcctttaagaaaaaaatagaagaaaatttagcttatttcttctaaagtaagagtggtatcttgagctagaatgtttgtgtatcaatgacgaacagtgctttttcttaagactggggcatgtattattcaggatatcgggacatcaaatgcacaacatttggagtctaaattctgcacttggttgtactactaaccaattgtgtgatctttgacaagtcccttcccgttcttagccttaatttctatctctaagtagagatggaaagaaggaatagggaacctctgtgatctcccctgattataaatctttatgattctgttgttctcttctagggttgccaaaaacacccaatggagaaaatgacctaaccctggattagtgactaggaatttgtttaacaactattctacaagcacctatgatccattggtgctttaaaattgtgacagcacagcaatgctcccctcaagggcaagtcaatcccatttaagtagatatgcataatgaattgctgtgagaaaacaagtgacagttttaattttaaaaacaacaacaataacaacaacaacaaaaaagcttacctgggcaccacctgcactttcccaaactgtgaagctctggaacagagtggtgccagtgacattatcccaaggtggctgaaatttagggtatacaaagagaccatacctaaaaagtgaaacagaatgaaattaagccaatttttatgtttctaactttctactttttcttgttgaaaaatacaaagtaaaagtaatgtattagggagaatgaaggtagatggaatctgtgaccctccccctaactgttcttgcctacccctcagccctcccacttttaccctctgtgacctgctcccgaatcccaacaaaatgcagattactccagagcccaagcctagcagcctcccaggggctctgcatatttggaagtttaattgctctctctattgaattatctctggccacaaaaggtacattctgtccttctgccttttcatgtgactctcttctctttaccatcgaactgttatgatctagaaaataatgctaacacaattatatacaaaagccaagacatagaggcagccaagatgtccatcaataggttaatggctggggaaaatgtggtgtatatttgcaatggaatattattcagcctttaaagagaaggaaatcctgccatttgtgacaatacagataaacctgggggacactgtgctgggtgaggtaagccagacacagaagggcaatagtacatcatatcatttaaatgagaaatctaaaatattcaaacttatagaagcagagagtagaatggtggttggcaggggctggaaggaggggaaaatgggaagtattagtcaaagggtacaaagtttcagctatgcaaaatgaataagtcctagagatatacagtatggcaaaatgccaaagtatagaatacagcaaaattaacaatactatattctatacttaaaaatttgctaagaggtcagattttgtgtcaaacgttcttacagtaataataataattcaaataaagaggctctggaggaaaacttttagaggtgatagatatgtttgtgacacagatggtgatgatggttgcaggggtgtatacttatctccaaactcatcaagttgcatacattaaatatggacagctttttgtatgtcaattatacctcaaaaaagcagtttcagaaaatgcacaggaacatcacccaatctccaacaaatgcccaaagtgctctcattgtgagcattctacagtaaaatgtgaaatcataagacagccaaaacatagatgaatttccccaaagttacctggtacaagaatgtgcaatgttctgagtgaaggaaagaagcggagcttgtgatgtttggttggtcatgagatggaaaaagtagccatagccagcaccacacactctgttcccctacagaaattaagaagagttaaaaaatagttaccccatgtatgataaggttgctggaaagaaagactcttgtttgtactcatcccaattttatattcactttctgccaaagtacattaaaactctattatagactcatttattctttttttttccttttgggaacaaaaatagtgatatggtttggatttgtccccctgcccatatctcaggttgaattgtaatccccagtattggaggtagggcctggtgggaggtgactggatcacggggtcagtttctcgtgaatggtttagcactgtccccccttagtactgtcctcaccatagtaagtgagttctcatgagatctggtagtttaaaagtgtacagcaccttgtggctcccaccttgtcttgcctctgttcctgccatgtaagttgcctgctcctgctttgccttctgccgtgagtaaaggctccctgagacctgagacctccccagaaattgatgcttccatgtttcctgtatagcctgcagaaccatgagccaattaaacctcttttctttataagttacccagcctcaggtatttctttatagcaatgcgagaatgaactaataaaaatattgtcattcttcttcctccagccagctcaactagactgcaatttgcccatcttaataactggtatctcatgctcaagcctctttctaagcttccacagtgagtttactcatgacatctaaaattctcctctttggtgaatgcaacagtatatggtagctctccaaggcaaaggtgtaccttgaagtcaagcctacacaatgtgttctctctggctctttgaacaactcaacgatttgtctattggctgaaggccacatgattggaccagtcatgacttagtaccaagacagggtgactgagtacaactacaactcaaatctcttcaaagtgctcttgtcctgaatagactattaagtcgccttgatatttctttataggtcttactatctaaataatttcatgtattttatgtgttcatataaaatctgacttctctctcttggaccatatgagtttggggatctaattctgatcaaactgaacacaatgaggttatctttataaattcaatgaagtacctacaatatgttcatccctatgtaacatagacttaagacaaattaaaaaactgacttcctaaaggtttaagactgtacacagatgtatttttttttggcctacccaatgttcatatttttttggttccaacatgttcaaaccaagagatttaataaaaaattcagactttcagcttttctgagcccaaattcctgtgaagtagccacaggtcaggtgaagataagaagggccttccttcttggactgtggatgatttttccacagtcctcacccttcctggttcactcatttatgatccctgcctagtctctgcagtatttgaatttgcaacctcaactacaggcaacaaagtaaataacatgttggctattctatgaaagtttctatttctgctttcctgaatcacatctgagttctctcagtgtcacacgctcacatcttaaggatcccaagccttctctttatcatcagggagaaagaactctgagaaaaatcggggccctatcaggctgctgcactgcagtgatgctattagtgggaggaacaaagggccaatcgatcaagctatgagactacttcctatgtgcccacgtgcatctgacctctctcagtctgagtggttgtccaaagtcaagatgcccatgtctacctggagaacagaagttaaggaataggctgctcaggtgtaagccctgtgctacatagatgaagggagtctccaaggctcccacatgattcaatcctgatcacctgggggttttccatggcctggctggtgcgagacaaggaatgtctggagtatcctccttggaagtcactcaatcccgggaacacaaactatggggcttggagagctcatcctgaacactggcattagggtcacagtaaagagaatggggagtcataaggaccatgacactgtgccactcaacaagacattaaatgcctttctttaaaaaacaatacttcagtgcagccctctatgcagggctcagtggggactacgctgtgagcatccccttggaacagtttcttaaactttcgtgtgcaacctggtagagttgtcatatttagcaaataaaaacacagaatgcccagtgaaatttaaatttcagataaaaaataaaatattttagtataagtgtgtcgcaaacactatctgaaatttaaatttgaccaaatatgctgtattttatctggcaggctttacctgggggtatattagccaaaggtttttagatattttgatttattaggggggtgatgaggaagggatgagggacagtattctttactcttggccatcacaaggtgctctgataggtctgctgcaggtgatattttgaccccattttgagaactacttctctacaggtgattgagagagtaacgctaagggttactaacgttcctaggagacattcaaagaggagagagacactagaaaaaccacttcctggtgaagttttttgccatgagttgctttgggaacccactgcaaatggaagccactgctgaaaactgaaggaggatagagacctagaaatcagggggagaatccattgccaggtacccagcaaaaatgctgcccagctcagtgcaagttatatttatggtggattttttttttcccttagaagtattttttttttaagtaatgatgagtagaataataacactcatagtgaaaatctacagagaaggcactacagtccaggtactggattttagagtctcatttatttttacaatagttttatgagttttgtattattattacagtttcatagcaaagaaactgaagctcagagatgttgagtaactttcccaaagtcacagagcaaatagttgtcagagccagctccatccaagtccaagtctggaaaagttagagactagagtagagaaatgaaggtaggacccaaaggcaggatgcccaataatagggtgcaagtgaagaaacataaacaagagagtacaaagaaaagtcttgtcacccggtcacggacagaacaggcatttgctgtggcctccccagtagtggagacaacatattgaacaacatcctttgcagaagtcaatgtatcatggacattcacgcaagggaaattccagagagaaattaactgtccaagtaagccagctcctagaggtgtgcatctatagtcaccagaaaaaaaaaaaaagtgaattaatccttaaggcaccggaggtagtgtttgatttctccaaatctggagagcatcttgcaggccagatttaactaaggagttgctcttttcacaccccaaatccagagaatgtaaaatccttctcattctcaccacatggggaaaaaagcatgcacagcttagcgtgcacagagagatacatgggtaggggtgtgggacatttctcaagagtaggaagaagacatgacattttgaagagtacatttaaggaggatgagggttctggaatttcagcattatggagatcaagtgttattaaggctgagacatgttgatgaggactggcttctgacacaggaattttgagcaatgacagatgaaaagactgagattatctgcagttgtcatctactatcagtgcagacagtagggctatggactgaatgcagacaagggttagaatttaatgaggaagttctgacccatccaaggacagggtcttgcactagcctttcacacagctcagggagttttactacattctcagtaaggatggattgagagtgaggactccatacccttttacttgtagctattctccatttctttatccttagactaagtaaactcatttcatcctatggcttcagtcattctagactaatatttttattgactttaatttccaaatgaaaggaaaacttcaggttttggggttttgtttttttgtttgtttgtttgttttcttttttgagatggagtttcactcttgttgcccaggctggagtgcaatggcacgatctcggctcaccgcaacctccacctcccggattcaagcgattctcctgccttagcctcctgagtagctgggattacaggcatgcaccaccatgcctggctaattttgtatttttagtagaaatggggtttctccatgttggtcaagctggtctcaaactcccgacctcaggtgatccgcccaccttggcctcccaaagtgctgggattataggcatgaggcaccgtgcccagccaactttaggtattattaagggtaactctctgaacatggctgatccactggcagtgataatatagcggcacccccaacaggagaagaacttaaagaccctattccttcctgaatgtaccacatgttccacaaggaacacacacacacacacacacacacacacacacacacattcagccaagcaaagacagtatgggggagaaaactgaaaaagattgctcttaacccaataacgcccaattccctgccttgtgtgacagaaagaaccaatgcctcaacccctggaggccttcagttttgggggaagtgtgagtcagggccagagttccccctgaaactagaagcctgaccagcaggcagcagccaggacctggtcagggaggccagcacatactgacacaattgccccgggctgtttatttagctttagcttcaattcactgtgggtcccaaaggttcttaccctgggtatttgtaaatagacagccatttcttcctcatttttcattcggttacaggatgttttgttcctttgtggactaattggccgagtcactcctgcacttcattattttggagtctgagcaattctccaatttcctaaaagcacttagaattctaatcacatgtctcacctaccacagggtgctcaccaaaagtgacttttggatatcactgaatattaagatgaatcactatcaaagatgccaacacgacttcaaagaatcaggtccatttctaagacttcaatggtcttagggtggcctagtctagagtggtggttgtcaatcagggatgactttgttccctacggaacatttaacagcctctggatacattttttattgtaacaacttggaggatgaagaagagagaagagggctactggtattcagtgcatagataccagggatgctgttatacagaggataggctcgacaacaaggaattacccagcccaaaatgtcaatattgacgtagttgagaaaccttggtctatagtctacactagagtcacatattagcaaaataacccacactcattttccagtatcccatctccaaattttgatggaaagacaagcctaaatatgaaaacatggttaattacaataagaatgctttaatagtctttactaggaaactattgatatcatttaaaaccattagatgaggcatcaggcattcccattaaaaaaacatttattagcattaaatcagctatctcaatttttctcttgtgctagaaaacagagtatgcactcctgcttcttggcctcaagaagaatcactgtctattagttggcaaatataagtgcccagtgtatctcttcagcccttgtaaatatacaaagaaataccacagctgttgttctcagtcacgattacacaacacaaactttccccagggaagtgaaactccaccttctctaggtgtgtctctctatatccacgagccttgggaaaggtcagcggtacataagaaccgagggccagagaagggggcttcttaaacacccaccttgtctgcaagtatacaatgagaaatgtggactggaagctaaaagtgatcatctcacttgtccacacagctctatttcattaccaaggaaatgctatttcattaccaagattttatgaggaaagaaaagattcttaaatttaaaaaatatattccaaggactgcatccttattcatcacctttgccagcacagatgctcagaaagcacgtgtttccctgaataaatgggtttgttgaatcatctgccctagtgccattagcatttatggcacatctgggtgatcacatataaacactttccaagcgcatttataggtgggcaggagactgcaactttggtcctctgttagctgataagactcacttttcttacaaaagaagcactttaacagtcagatcgcattccttcctggcccttcttactctcaactccaattgtgtatgctacaaatgattcatgaggaaaaaccacatatttatgcaggcagctggcagcttgcggggaaggtttaaggcaagcagggaattttgtgtggaaatcaattatttgcggaagtcaatgtattatggacattcaagcaagagaaattccagagagaaattaactgcccaagtaagccagctccttgaggtgtacatctatagtcactagaaaaaaagtgagttaacccttcaggcagctcttaaatatgcattacctattgagtggggaaagcttgagaactgaggttgggcctttaaacagaattccttacaaaattgattcacaaaccagaacaaattctcctcaaattaaatgcatgtctccaaagggctcttcttcagagtttttccacggactatcctaaacaggggtctggttataggaaatttccaacacctacataaacatgggagactctgagctctggaagtgaacagtcccttgctgtttgagagcaaagacttcccaaccagagagaatgagaacagattcacacaggttatgtcttctggaaagatgcagcctcttgacagataacaaggagctcctgtcaaagaagtcctagactccggagctggagctgctgagggaagacagcctgagggtgaagcgctctaagaagctacaggtgatacacaaaagaaccaccaccaacttgcttttggaaagcatggcaaacgcctatttaagaaatgtaccagggaatgccacaggcccctggagactcaagcacttatcacccatgggtcctcactggcaagaaggtacaaagctcaggttttgcttctcagtgaaactgccctggactcacctcagctgcaggctgggcagggagagaagcagaccacctgtgaacatcaaaactaaaaaagaatatcatatttgaaatttacttgcatcatgccaggttgaatgtaagtgaactagcaaggtgactgactgcaagcccagctgaattccttatgttgtggctgagagtttggtcccagctctgcatcagggcaatttgagaataatataaaaccacaaaccattgcacagacttaagaatcatttcccctgcctacctaccttccaggtcagagatttcaaggtcagactcaggtatgtgaggagagagagtttaggctttcagagttggttgcccaaacatgaagattaggccatcttcttcaagtctaaataaatacatttgtttaattaatactatcataccaatgtcaatgtcctggccttggtacagctccatgactatggttatcgttatgttatcattggagggagctagatgaagagcacataggaattctcttatttatgcagcttctcgtaagtctgaaattattttaaaattaaaagtttaaaataacaacaaagaaaaatcctaattaatcacaattttctatcacatctctttctgttccacatattatacacatacacacaaatacatgcacatacatacacacacaccttgttattgtggaagcctccttattatccctttggaataaaggtatatttctaaaatatgttcttcaaagtactctgtatatcatccatacaggacacaattaacactaactcagccaagaatggtggctcacacctgtaattccaatcctttgggaagccaaagtggggagatcacttgagaccaagagtttgagactcgcctagggaacacaggtttttttcacgtatacccagttaccacctatgtctttaagtaatggcacatcacagacaatagaatgcaaaaaaagactgaataacagaaagccaatggcacaactgaaaaactggactagactttgcaagatttaatgctgatagcccaacagaatctaaatgcttccactgactaaacttatttttcagtcatcaaaatgattttagaactttggaacttgttctttactttcctttttcttcccccacataatttggttataggtttataccttcattcgttatattaaatacatttttttttgagcaactaccatgttttagaaattgtgctagtgtctaaaggctaatgaaaatagaattagaactttaaggtcaccggaggagccaagatggccgaataggaacagctccggtctacagctcccagtgtgagcgacacagaagacaggcgatttctgcatttccatctgaggtaccgggttcatctcactagggagtgccagacagtgggcgcaggtcagtgggtgcgcccaccgtgcacaagccgaagcagggtgaggcattgcctcactcgggaagctcaaggggtcagggagttccctttcctagtcaaacaaaggggtgatggacggcacctggaaaatcgggtcactcccacccgaatactgcgcttttccgacgggcttaaaaaacggcacaccacaagattatatcccgcacctggctcggagggtcctatgcccacggagtctcgctgattgctagcacagcagtctgagatcaaactgcaagtcggtagccaggctggaggaggggcgcccaccattgcccaggctcgcttaggtaaacaaagcagcccggaagctcgaactgggtggagcccaccacagctcaaggaggcctgcctgcctctgtaggctccacctctgggggcagggcacagacaaacagacaacagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccaacaggggcacactgacacctcacacggcagggtactccaacagacctgcagctgagggtcctgtctgttaaaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgacgagctgagagaagaaggcttcagacgatcaaattactccaagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccatgcgatcaactggaagaaagggtatcagcgatggaagatgaagtgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatagagagaacgccacaaagatattcatcgagaagagcaactccaagacacataattgtcagattcaccaaagttgaaatgaagggaaaaatgttaagggcagccagagagaaaggtcgggttaccctcaaagggaagcccatcagactaacagcggatctcttggcagaaaccctacaagccagaagagtgtgggggccaatattcaacattcttaaagaaaagaattttcaacccagaatttcatatccagccaaacgaagcctcataagtgaaggagaaataaaatcctttacagacaagcaaatgctgagagattttgtcaccaccaggcctgccctaaaagagctcctgaaggaagcactaaacatggaatggaacaaccggtaccagccactgcaaaatcatgccaaaatgtaaagaccattgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaagaccattacataatggtaaacggatcaattcaacaagaagagttaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaattcagctctgcaccaagcgaacctaatagacatctacagaactctccacctcaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatggagacacaaaaaacccttcaaaaaattaatgaatccaggagctggttttttgaaaggatcaacaaaatagatagactgctagcaagactaataaagaaaaaaaagagagaagaatcaaatagacgcaataaaaaatgataaaggggatatcaccaccgatcccacagaaatacaaactaccatcagagaataccacaaacacctctacgcaaataaactagaaaatttagaagaaatggataaattcctgaacacatacactctccagagactaaaccaggaagaagttgaatctctgaatagaccaataacaggatctgaaattgtggcaataatcaatagcttaccaaccaaaaagagtccaggaccaggcagattcacagccgaattctaccagaggtacaaggaggaactggtaccattccttctgaaactattccaatccatagaaaaagagggaatcctccctaactcaatttatgaggccagcatcattctgatacctaagccgggcagagacacaaccaaaaaagagaactttacaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacagaattatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacgaagtcaaattgtccctgtttacagaagacatgattgtatatctggaaagccccattgtctcagcccaaaatctccataacctgataagcaacttcagcaaagtctcaggatacaatatcaatgtacaaaaatcacaagcattcttatacaccaacaacagacaaacagagtgccaaatcatgagtgaactcccattcacaattgcttcaaagagaataaaatacctaggaatccaacttacaagggatgtgaaggacctcttcaaggagaactacaaaccactgctcaaggaaatcaaagaggatacaaacaaatggaagaacattccatgctcatgggtaggaagaatcaatatcgtgaaaatggccatactgcccaaggtaatttacagattcagtgccatccccatcaagctaccaaggactttcttcacagaattggaaaaaaaactactttaaagttcatatggaaccaaaaaaagagcccgcatcgccaagtcaatcctaagccaaaagaacaaagctggaggcatcaccctacctgacttcaaactatactacaaggctacagtaaccaaaacagcatggtactggtaccaaaacagagatgtagatcaatggaacagaacagagccctcagaaataacgctgcatatctacaactatctgatctttgacaaacctgagaaaaacaagcaatggggaaaggattccctatttaataaatggtgctgggaaaattggctagccatatgtagaaagctgaaactggatcacttccttacaccttattcaaaaatcaattcaagatggattaaagacttaaatgatagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaccccatcaaaaagtgggtgaaggacatgaacagacacttctcaaaagaagacatttatggagccaaaaaacacataaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaaatcagtgtggtgattcctcagggatctagaactagaaataccatttgacccagccatcccattactgggtatataaacccaaaggactataaatcatgctgctataaagacacatgcacacgtatgtttattgcggcattagtcacaatagcaaagacttggaaccaacccaaatgtccaacaatgatagactgcatcaagaaaacgtggcacatatataccgtggaatactatgcagccataaaaaatgatgagttcatgtcctttgtagggacatggatgaaattggaaatcatcattctcagtaaactatcgcaagaacaaaaaaccaaacaccgcatattctcactcaaaggtgggaattgaacaatgagatcacatggacacaggaaggggaacatcacactctggggactgttgtggggtggggggagtggggaggaatagcactgggagatatacctagtgctagatgacaagttagtgggtacagcgcaccagcatggcacatgtatacatatgtaactaacatgcacaatgtgctcatgtaccctaaaacttaaagtataataataaaagaaaaaaaaacttaaaaaaaaaaaaaaagaactttaaggtcaccaaggataaatatgtcaggaatatacctaatgaatctacattaccagtttaacctaaaactccattctcaaaacatatgcattgtattttttttctaattttgtaaagcagatacaagagtaagaaagtaaatgaagggaaatggaaagcgttggagggagagcaagcagctagttgcagactcaatttttccattgctgactgggtattattctacaggtcattttgcaaaggctcacaccacccacagcttttcagattaccctctggttctctgcacctgcagccagctcaacccttcttcttgtcagccagtggccagcactccgtccagcagaccacatactacccagtgagacaaggacattccagcttcacacagcagggtgagctgggcaaccctgagggtttactttcctccaggcatttgatgtagtcaacattatgctacccagaaaagtacacaaaaacatggtttcttaagcccaaaagcttacagacatagaaagggcacataggaactcttttatttacgcagcttcttgtaagtctgaaattattttaaaattaaaagtttaaaataacaacaaaaaaatcctaattatcattaggatttttggcctgtagtgaccaacaagttaaatgcagctccagctgtcctggatctgggatctgggttcctacagtccgtgtagttctgcttcctttgcttactggcatattagccactcccattaggcacctaaaatggtgtgtgagtgctgtgcttggaacaaacataattaagaatctaaggaagaagagataaccactacttttactagggtttattcagctgaaggtaattaaaaacagatgatcagtgagaaagaagctcatcctctgagttccttagaaactcagcataatgacatagtggatgctgagaggagtttcctgaaacagtgaggcccttaactcctttgatagaagatccatgggataaaataattagaaaaggggaaatgaaatggcttgccactactctgatgcacttgttcactcaggtctacagctacattgtcccctcaaaaattaatttcttaaatgtttaaacagaaatgtgccaagggaaaccaatgttaagttgtactaaataatgggattttaaaaatcaaggttattgaagtggacttcatcctcctggaatctgacatgaccttatacacctcatgtctcagttttgaacactcttaaaggacaaaatatggccacattaacatagtaagatagtgaaggtttaaaaagaaattggtattggaatcaagtgagacaaaaatcagcacccagagttggtagttcagggagatattttagtttgcattacctagatgaccaggaaacgatcaatatctactttgttttgctccattacctattgcttcaaaaaagtgtttccagaaatcctgagaggaatgcttacatttatcctaaagtacttgtttaatgcaaaattataaattattttcttgatactaatatgcagcaagtaaacatttcataccacaccaccactaacgctgccaccttaaagaacttttggagcaagcttgtccaactggcagcccacaggtcgtatgcagcccaagatggctttgaatgtggccaaacacaaattcatcaactttcttaacacattatgagatttgttttacaattttttttcagctcatcagctgtcattagcgttagtgcattttatgtgtgacccaattcttccaatggcaattattcttccaatgtggcccagggaagccaaaaggttggacacccctgattgagaaagaactttatgccctctcagttctggtcttcctggtagagctgaacatcttacctctataacattggtgggactgcagatatagatgccagatggtgtcaacatttcaggattggagagtccctcggcaccagaaacctggatgatcacgttgtttcttattatatttccatgtcctgaccagtctaatgtttcaacaaatccaggggatccacaaacataattaaaatgtactcaactcaacacccttgattctactaatacacatcagagttcacataatgcatttcatatatatatatatatatatatatatatttagaaaatatttagtatgcacaataaacttaagagacctaacattttgccatcaggcttgtctataaaatatatgacaattttaaatacactgtaatagatttaaaatcaatttacatatttaccatctttccttccatgaattgcctcccaggagatatatctcatctccgtgcatgtccctgagaacaaaagaccccattacttgagtatattttatgtcacttaggaaaacaagagatgctgcaacactacttctttgggtgtgggttgttttgattttgtttttgtgtttttatctgtaaatcagggaaagagatacagatcttatgtactcttcagttctagagtatcaggaatcagaagttcattttaaataaaaagaacagaaaaatagatctgttttacttttgaggaggagtctaagtgactatctccactgttaagtgccacatatcctgtgtcaacaccaaccccattcctagctgttcaaactggccacctgctatctgcatgccctcaccttcccttggaagatctgaaatgtcctgtaggaacaggatggacaacatctaggaccttctcacccaaaccactgaggttggaatagaagagcaagcatgggccatgctaatagagaaattagtcacttaagggctatcaataaagagctgccccaaagaacccttcattacaaagtctttaagtatctaggcttcctcatgccatttcatgggtctgggtttgcatacttgttatgtgtgagattgagtgctttacccaccacacatcaataaacaaaaattttaattccctcacttgtaatacaatagatgtcaaaatcttataattcacaacattcaagcactaaaggctaaattctgcctacaggttttcttccttgcatagttaatatctattccacataattgttttctgctaaggtaatactgttaggatacctttctcaatttctccttgatgtttcaccttttcccttgcacggacaaacataggaacaaacaaagtcaatcctacatctgttagttgacttccctgtggctgtccttttctaatcaaaagatttttctgcacctgatcacctcagttacccttagtttttgtcttttagagctagagtatgttttaaagcaaatgtatctgattcacattttctcactagacagtttccatctcaggatagaacttttatagcttttatctcaacagattgttcttaaatgaaacatgtatttttcccactgatgatactatagaattaaatatcaaacggtatttaacaaatacagttatattctcactttcagtgaaaacctctgatttgcttttttattctgataaaactggagaccctttgtttcttaattcattcatttctttcaactaatagatctacaatgcactagttaatatgctaagtgttcaggagacaatgtcctcaagaaatccggtggtataaagacattaatcagatgaccagaaatgtggtatataattttaaatcaagaagtactgattggcgcttaaagagcttaaacagaaggacttgtctgggagagagaatgttgcaagagaagagtaagtggcatgaacagagccagagagcttgtgcaaagaccctgaggaaggaaaaagtgtggtcttttgaaggaactaaaataaaatattttaatgtcactagagtatggagaaagagaaaaaaaacaagacaagtttacagaagttaacagagacaaaatcactgaagggatcttttaagtctggtgaaaagtttgggattctattttaaaagcaataagaatctcaaaggagagaagtgatatgatgcaatctgagatttttaaggataattctgagttttgcaaggggaatgaactttaggaaacagaagtagatagagttgatcagttgaagattctgaaacatgggcttcttcagcaagccacaggagcttgaattctattaagaagagaattccagatttttaaatccttggccaacatccaagtttgacagtctgtaagactatacaaagacatatgcatgtgacttagaattattgtgaaaattactggtagtaaactttaaaacttcccattatacacttattaacctgaactaacctttaaaagatcagtatcctataggtaaagtttagtaagccaatcagtgatgactacatttaaatttagaatgttttactgtagcccatttctagtgatcataaagccaatatttttataaattaggaattagaaatttggggagaattcattgtgaaaaactgtgtcctacacaagaatgcagaaattcaacaagcttgttttacttaccaactagcagcgcatgacctaaaatattgtagaatacattactgtccaccttcaggcccaaggtcccgcacatgctgaggcctctactgaaggagttcctcactgtgcagccctgtatgaaagactctgaataggaaagagtaaagtaaaaattagatatggctcctgagattctgttgaccatatttagagcaacctacactgtagctaaagacattctcccacacaataatgaaactcaggagataagaagttagaagcagcaatcgaatcaagagaatgagtaactcaaaccaatgggcctcaataataaaaagggtgaaattcaacaatcaagtgttagaaaaaaaaaaacaatctgagaaagacaaagtatgtctaaacaataaaagaactcatggctgtcaagatttccaactggctatcatctttagtatcagctttcatcataatacagcagatgagaagttaaggataacgtgaagagcactgcttatgggccagccttgatctttgaaacctggagcagtgaattaatatttataatttatcaggcaataatattcttggcccaagatagccagagactcattcctaactgtaagcaaggtcaaaggttggcctgaggatcatgactctcacatttgaactggataggtttatacaactaaagaggaagctatcctctactacgctaaaaaattgacaattaggaaaatcattacactggttccataggcatattctatgatccccagatctggttacgaggcctagatgagtcaatgaatacacaattactgagtatcaactatatgtttcaggaattgtgcattgcattgtgctggaaacataaagatgaatgaaactaagtaacctctgcattcatgtatttgcattctgatggaggaaactgacattaaaataataaaaatccattatttgaataattaaactataaatcctaaaaagggagctttgtattattactaggtagtgagaaagatacagatgccaagtgctgggatattagaaaagttactttagtttacagaataatttgacttttacagttgggactatccaaaaaattctaaactttaacatcactatcaacactggatctccacattcccctcaatctcagctctcctactactaggtgccctcacattgctcatcaaggatccaccccaataaattaacccatccatatctacttctgtagcaaacactgcccatagtgcacagaatcttcaccatatcacccaaacagcataggcctgaccatgtgaaaaaccagtaagtacttatgtgtttgtgtagctcttatgggcggaatactgggattagtgaacctttaaaaagtactgtgcaacatttacctatgtaacaaacctgcacatcctgcacatgtaccctagaacttaaaattaaattaaattttttaaaaagtactgttcaaatatcccaatgctttctaactctggtagctgggagtaattagctgcgtaggacatgaggggcttcagggtgttaaacaataaaagattccttaatgagcattccaaaagtttctagcctctgcattttaacagggatttaaaggtaataaatgtattaatgcagtaattttcaaacttttattttttaagcactgaactctttttcaaataaaacctaaaatataaaatatctataaaaatagatgagtgtgcagctactctgattgaaacagaggtgggagagataggttaggtaaaatttgatcaaggaagggctttgattatgttcaattgataacttatttgtgacagctaccctcttttttactgaattggccgcatgtcaaatattctgcagtactatatacagctgaccaaagaaccagagagaaggaaataaagatactaatcaatccgaagcactagcggagaggccatatgcggagccatcctctgaaatgactcaaataaatttaaaaagattggaaaaattagaagaaatagacgtccttagcatgcagataatttgaaatgaaggaaaatgttgcttctggcagttcagaatcctgccctcaatgacctgaaggattactctgcaattacctgttagaatcctagcatctctcaaaagccacctgaaccacaaagtatgccctgatgtcctttgtcaggcatcaacctctgaacccctggggcacagcctctttaaagaaggcaaagcttgaatgtgtgggtgttgaaagtgctgatgaatggggaggattactcagaaatggagctgctgtcctcctgacttggcatctgcacccccattctgtgattctctgcatgtcagcttttggtaatgagtttttgccctggatgttcctacattcaacttttattttagaacttttatcagtgcatttggtcatattctgtttttctgattctgatcttgtttttcacctagttgttctcacctgaatttgatgtttcctgctcccttcttatatcttcatgtctggccaagatctgcacatgtaactgctcctcatttccagaaaaagcacctgggtttcagcccattccccctcatttccccaggcaaaagattcctctgatttaggacaactttacatagaagtgcctggactcccacagtgttgataatgtaatgccaattcacctgtagtcacaaagctagtaagtggtagagacagaattcaaaacacaggattgtgtggttcactcttgtgtgctgtattatagtgatagttctcaaactggactccttggactgcctgttccagaatcaaaaggtttgtatttaaaatacacattcctaagcctaccttagaccagaatttgttggggtaaggtctataactctgaattttaataagctccacaagtgatttgtttaggcatactgaagtttgggaaccatagacctagaatataacaattatccatctctaaatccctcaaatcccacatatcatctatcattccaccatgcatgtagtgccttaaacatgggagaaagaaacatgagaaagtcctaggtccggacccccttacctctcatagctcccaccagagtgagtgagctcagatgcttatggaaggcttgccccaagacttgaaactgcactcccttcaactggacctggctgggctcttctgggaaggactgaacgatcactctggctcccatatccctggatcctagcatcttctcactcatggaatacaaacagtgctgcagattacctgaaatgcaaaataaagtccagagaacctaaagcatgtagaacatgcttccagacaaatctcccagtttgaaaggtactgtcagcaccgaggaaaaaccattactgtttatttcatttaataatcttatttccccttttctttgattctcctctgtatattattaattaaaagatctgataaacaggacatgatgttgccttcattctattttttcaagaaactcccaaatcaatcaccttaattactgtcacaaagagtcagactataacccacaaacccaacctaaatagatgcttatttcaatctaaaagatcctctggaggaaatgtgcaataaaatgaccttcttgtggttgataattgtaggaaagacatgttagcactgaatataataacagcactttttaatcttaagctgtccaatgaggtttccccattactgtgctgttttatggtttggggacttagcaataacgctaccacagaaatgtcaaaggactccagagaagcaactgagcagctcctgcaccaacacctacttccccagctgtgccactaatgaggacagcagcaacctgagcctaacacacacaactacaaatgccagtgaggacagcaaccacctgaactaacacacacaactatgaatgccagggagggcagcaaaccacctggacctaacacacacaactactattgctaccaaaatgttgtgacctcaggatccagggcaccttctgttgatacatggcatttggtggtacaaactaatctggagaataaatcatctctccaatggataataaagatttttcatgttaatgatccaaagaagcaccaataatataaaacactgtatcatatcacagtaaatttcagaatccaatcatttgctattacccagagaagaggtgaatgaagagatatttatatttgtatgccttatcacaatttgattatttgtgccactgatccataagattttcaaatggacaggccttgtgttattaaattcagctaccttgttccacactccagccccacacagaaaagaaatgacttattttgagaatattgtagttgtatttacgatttgtgatgcaatcaaggatgttttccatttggggctaacagatttataatggcttaaacctagaagcatgatctcactggcagcatgatcaaatgcaatatttggcaaaatatgatctcagaataccaaggaagtttgaatagaatgtagatcccaattctgcagaattgataaagttgggcagttgatggaagtgaacccactgttatccaaacattctttttagaatgacacatttgtgagtagatgatttgtagggagggaggtgaggccaaactgcctctctacttctaacaactccccacacccaaccacatggcaacattttactcacatgcacctatatttagacacaactcaaatctttaactccagctccctttgacctttcttccaggctccacacattaccagacatctctacacagttggctggcctgctggcatctcagttatgacatatacaaaattaaactcacgattgccactctcccaccccaaaacctgctcctcttcccatcccagcaaatagcctcatcatccatccagagctcatgcctggaagtcatccttgacacccacgccatcctggaccaaagttgacaaatgatgtcttcacaacatgtgaaagcctcataatctacagcctgggaaaccaaaacatgacctactaaactaaccatccctgaaatagatgcttaataggcacatcaatgtgattcagtgcctgctattctactagaagataaattgaatttttccaccacttacctaaagtatgtggtagttcactcagaaaacaaatcccaaaatggggatgggggagccctacaagtctaatcagtaagaatgtgctgcctgagcccagaactctggcatatggctttcctgagaatcttagaagtggcctggaattttaacattgaacccagaaatgtaattcaactcttcagatttagttctttaatagaaatattttccccagagaaataatattttatttcttttgtcttttgttatctttttcacaaggttgttgggcagtggggcagagaggaggatgaaatgacaatcaagagcattctgaaaactacagaaaagtatgggcatccaaagtttaagggcttattctattttaaaagaggtcaaccacagcaatgccatctatcatcagacagtaagaatattcttttttgctcattagactttccaacaaaacactcttctaccttctggagcattggcctcctggcatgaaacaagcagcttctccctctcattagtgagatttccttgtatggtaatactcctgctgagcagagccacagtggcctttaaaatatggtgctctccagccacccaattctctgtaaagttgtgagaatatctggagaaaaaaagaggatgatagaactgaggacatcactccaaatcttactaggaataataagccactagattaacataattcttcctttggggatctattcatgtttctttagaaactcaataccaaatagtgaactatagacacaagtacatgaaaattagaaactatgctgatcattgccccaaacatttgtgtaagacagaagttctagagacaagacaaactaacttacaaagtctaaatcttcaaaacatttcatgctttttaattttcttgtcaaaatgtctaccattatttaagcagaagaaatatatcattgaaagaccccaatacaaatgtccagaccccaatacagttaagatctcatcttcttccatgtcaacttagccaagctgacactcagtacctcaaaggtgacttaagatagaggtctgtatcctgcacagtttccacagtgacaatctcttccatcggtttggcacctttaacacctgttccactgatgatgacaacttcatccccagggttccagtccacagcatcttctaaagccagcactgtgtctagggcatgggcagttgctctaagacaggtgacaattacttctggtagtgaacctaaagcagcccgaggaaaagttgtccagataatttaatcattaatcaaaacgtgattaatttaatcattaataaatgtgatgttatttagccaaagaatcccataaaataagacctggaaaagcaagcttcaggataggtaagcactaatttttttatattagttttgttttattttgtttgaccttggttttctttttatctataaaaagaagtcaataaaagtaagccagactagagaatagcaacgtgtaaaaagcacaagaattgtggtcagattacacttatatttgaatcacgatcttttcatattctaaccctattctttagggtaataaacttgatgaatgggcttcagtttcctcagttaaaaacagaagtagcagggtcttccatcatagggttttggaaggattcaatgaaatagtatctatgaaacatctagcttggatcttaccacataatagaccctaagggtatgttagtcctttctcttccttttctgtgtcacactgtttgaggatgaaattttaccacctcttttttattccaagaaaaaacaagtggttattagactttctgatgtagacctccataactaatttccaatatgaagacttcacaaataacaaaaatagaggggaaaacaaaaattatctcttagagttgtcataagtcttggtgtattaaatgatcccttcaaactctaaaaactagacctatctaacataggactgctaaatgcagttgaagaaggggaacttgtggttcaagataaactttgtttgtattacactccagcatacccgcctgaccatccccataccagcatgctaatctctaattatcaaagattcaagaaggtcatctgtctcacagtttattctggtcttttccagcaagggtcaaggcacagattttttcaaggcattatctgaatacttcagaaaacacatggcttactccctactccttcctctttctgtagtacatttccttcctcttttgcaatggatgataatttacctttagcccgcagcaagttactgtcctcccttgttgtactaaagtaaagtaataatacttgaatctctaactacagaggtggccgacaataaatcattttcaaattattttaaactttcctctttatttatttgtctctctgtgcataagcacttgtaccaataatgttctaggtttagaaaggtctctgggttaatattgtaatttctgaagtttacttgggcaataattttgtcttaaaaaaatgtacagagttcaaaatttctaattataaggcaggtgaaaattaagacataaatcatcccaaaagaaaataattttaactttatttcttgtttgtatatcttaacccttggaaacaataaaatgaaataaaatttatttatatgtatatgcatatatatgtgaatttttataacccattcttgaatgcctacatagaaaaatctctactaagcacagaaaaatgtttatccaagacaaaatgccgtcagactctgtgatcagtattcacaattctcaattaatatgcaacaaatacctgctatgtgactatcaacatgcaagctacgcatggcagaaccaagagtaaagaccacaaaggtctagctcaactagttactcctataaataatggtcaactctgaatggatgaaaaaattcacagataatctttgaagtacatttttaaactattaacaaaaaagttacatctttgtaaatattgacagagcctctagaaagcagtaaaactagcttataacttatgcactcccattgcaaaaataacacctctatgtgtatggttaaaacatcaagcctggatgtttaatgagtgttggcctcatatttctagctacatagtagatattgacatttagatgagctactaccatcttgaaattattgtaataattatctgagctagaccctcttgcaaacagcttttattcctttaagtattcctccttatgttctttttttaaacaaattttgtgctaagttatttcaattacatcccttctttgtccattaacctgcagtattttcctgcaatactcagtaacaaagtctcaaatttgctgcttgacttcaaagactctccataatgtgaccctactttatggtctctgatttcttaataaattctgttccaagaagcccagtctctttacctcttctcatttaaccggatcgtcctgcctctaatcttttgtcaatttcgtcctttccgctcatgtccttgcttctttctcttcatctatccttttaaagcacaactcaagcccaatcttttcagtgaatttcagaacatacttcatcttcacttcctcctacaaaccttgtagtgatcagtgacatcgttccttcagcaaaatctgtgtgtacatctgggatttaggcattcccaagtatgtctgggtagcttgtgggccatttatttgagctgctttgtgtgggggaggaagtttgcacaaagaaacagatgagagaaaagaagatgacagagaagatatggggtcaatctcagatataggccctctctcttgaccacaaggacctatgactgaacctgagggaataatttggaggaaccctccagatggctttgtcacctgatgctgctccacctgagattctctcaccaactcactctgctgcattctttagaacttaatcctgagagaaggctccaagacttgctgagtaggcaaaccctgtatataatctgtcatatcaccatggctgtctcctttctcacacttaacacaactgcaatttggcctctatttctgtacttagaatttgtctcccccactaaacataacagcaaaaaccatacctatgttcattcaccgtcacaatatcaatgcctttcacagtgtctagcatgtaagtgttccataaatacatcctgaatgcataaaatcacaaatgagacagagaaacaagcaccccaatgtcttggtgtccagttgatcagatgggactctgagtggcatgcagagacagttgccacatttcatcatgggacacagtacactcccacatcttggggttttaaatgaaagcccacaccctcaaacccatgtgttcagtactctcatggcaggtaccagcagtagatgcagggatgaggcagcccctactaccttcctaaatggagaacaatgaccaagaagccaaagtaggaggaaaagaacatgaaagatgcctcatggtgactaaggcagacagatgaactcacagaaaacacattgtgagaacacgtagaacaagcaagcagaactgctaaaaaggggagaaggttttgtgagagttgggggcctcagacagtaaaatttttatcactattgaaatatccacaggctgagcaggctcagggaagcctggggagacttcaattacataaacaatagtcagtcccatgtatctcagcactaaatcatcctgaaattactaaagtgcatgtgtcttttctctccaccttacaggtggcaccatgactgctgtgccactgcctcatgtctcctttatatatggcacaattcctaacacagcactggacgcataattaacattcaattcatagtggtttaaatgacctattttaagtattgccttctgggcaatcacttgtaaactcccatcagatatatacccaagtgagtatataatattcaatatgcaaaaagcagaaaaaaatacaaacatttattgaaaacttagaataaccccaacctatgcaaactagtttcattgtcaagtaagaaatctttggttttttatttttgttatttattttaacagattgtacagataggaaactatgattcttcaaggacaagattatatggtaatagatatcagcacaaagttctgaaactagttcttctgaatctaagaccagagaactagacaagtaaatggaatttgtagcctctggaaatagctgtaaattaactgtacccaattagctttgatgttcaaaaaattatactcattacttcataaatgttatttaaatgtcatacaaggtggaccaactgacttctctgatgaagaaggcattgcacacattttacatctgagtcatttctgttcatagaactattgaaacccaggttgggtagctcccttcctttctgtaccacaaatcaaaaacacataaaactacgcataaaaagctcaataatttatgaatatgctaaatgaaaaaggactatgcttttaacttgtaatttaatactatgtttaatcactttgggctttccatgttgacctgttaaccaacaaactactcatttactcccactaatgacttctactcataattgtatttcctacaaattattgttcaagcatttcaatgtcattcatccataattacacagtctcagagcaccattcttactaaatgggcatggagaaaaataaaataatccttgtgggttaacacactaaaatcactaattgtcctctgtttgcttactttgtaggacttaaatctttattctaagaataactgccaaggcctttcaaaatcatttagggtgggggagggagagagggagagagggagaggtgggggggagagagagagagagagagagaaaggagaaagaaaaggataatttattaaaataatgtttgcatcagaataaaggaacttacaaaaaaaactagaaatattgtcctcaaatatatacaaattatttcccccttatttctggatgcaacatcaccattatccatagcaaaacattagatgctgtcttgtatgtggatgaacatttgtcacgcactaggaagacaaacacaaagaacagagtccctttcctccagggcccatgatcagtacaagaaatagacaaaaatcagaagtgcactgtgcaaggtgcagtgacactcaggggtgtacagacatggagcactgcaatcacaccaagggagtggtcctttccaggaatgcttcccagaagaggtgataactgagctgggtcttgaaggacaaaccaaagtgtgccagatgacaaaatgggaagcgtaccctaggcaacgacaatgatgtgtaagatggtgggggacattcgaataactgctacatatgtggcatggccagagtacaggtatacagaaggtataggcacctagtgactgtcccttcattctgaagaggtgagcaggacccatccaaaaatgactcacaggccctcccatagcacttagagtttatcctaaaaattatttggaaaccactaaatgaatatttgggatgaaatctaagaaatgatactgttgtgaaactgttttaagcccatagtacacatatcaaactaagagaagaaaatccttagtgagaaaatggacttactgtatgttggggaaaatgagtcaaatcctaagacaaacaagagccagccagtagggaaactgagagcctgatgtgttactctatgaactagatatcagacctttggagcaaatgaagaggactgggcaaaataatgcaggactttgttgacctgttttaaagaccttaagttgtatttgaaatagttataaaaacaaatatatacatatatatattcattatttatttttatatatttatttttaagttctgggatacatgcgcagaacgtgcaggtttgttacataggtatacacgtgccatggtggtttgctgcacccatcaacccatcatctacattaggtatttctcctaatgctctctttccccttgccccccacccactaacaggccctggtgtgtgatgttgccctccctgtgtccatgtgttgtcattgttcaactcctgcttatgagtgagaacatgtgtttgattttctgtcttgtgttagtttgctgagaatgatggtttccagcttcatccatgtccctgcaaaggacatgaactcatccttttttatggctgcatagtattccacagtatagatgtgccgcattttctttatccagtctatcattgatgggcatttgggttggttccaagtctttgctattgtgaacagtgattcaataaacatacgtgtgcatgtgtctttatggttgaatgatttataatcctttgggtatatacccagtaatgggattgctgggtcaaatggtatttctggttcctgatccttgaggaatcaccacactatcttccagtgtaaaagtgtttctatttctacacatccactccagcatctgttatttcctgactttttaatgatcaccattctcactggtgtgagatggtatattgaccagtaatgatgagcttttattcatatgtttgttgatcgcataaatatcttcctttgagaagtgtctattcatatccttcgcccactttttgatggggttgttttttcttgtaaatttgtctaagttccttgtagactctggaaattagccctttgtcagatggatagattgcaaatattttctcccattctgtaggttgcctgttcactctcatgatagtttcttttgctatacagaagctctttagtttaattagatcccatttgtcaattttggcttctgttgccattgcttttgatgttttagtcatgaagtccttgcccatgcctacgtcctgaatggtattgcctaggtttttttctagggtttttatggttttaggtctaacatttaagactttaatcaaacttgaattaatttttgtataaggtgtaaggaagggatccaatttcagctttctacatatggctagccagttttcccagcaccatttattaaatagggaatcctttccccattgcttgtttctgtcaggtttgtcaaagatcagatggttgtagatgtgtggtattatttctgagggctctgttctgttccattggtctatatctctgttttggtacaagtaccatgctgttttggttactgttgccttgtaatatcgtttgaagtcaggtagcatgatgcctccagctttgttcttttggcttaggattgtcttggaaatgcaggctcttttttggttccacgtgaactttaaagaagttttttccaattctgtgaagaaagtccttggtagcttgatggggatggcattgaatctataacttaccttgggcagtatggccattttcacgatattgattcttcctatccatgagcatggaatgttcttccatttgtttgtgtcctctttgatttccttgagcagtggggtttgtagttctccttgaagaggtccttcacatcccttgtaagttggattcctaggtattttattctctttgaagcaattgtgaatgggagttcactcatgatttggttctttgtctgttattggtgtataagaatgcttgtgattttgcacactgattttgtatcctgagattttgctgaagttgcttatcagcttaaggagattctgggctgagaggattgggttttctaaatatacaatcatgtaatttgcaaacagggacaatttgacttcctcttttcctaattgaataccctttatttctttatcctgcctgatggcccaggccagaacttccaacactatgttgaataggcgtggtgagagagggcatccctgtcttgtgccagttttcaaagggaatgcttctggtttctgcccattcagtatgatattggctgtgggtttgtcatagatagctcttatgagtttgacatacatcccgtcaatacctagtttattcagagtttttagatgaagggctgttgaattttgtcgaaggccttttctgcatctattgagataatcatgtggtttttgtctttggttcggtttatatgctggattacatttattgatttgcgtatattgaaccagccttgcatcccaggtatgaagcccacttgatcttggtggataagctttttgatgtgctgctggatttggtttgccagtattttattgaggatttttgcatcaatgtttatcagggatattggtctaaaattctcttttttggttgtgtctctgccaggctttggtatcagaatgatgctggataaaatgagttagggaggattccctctttttctattgattggaatagtttcagaaggaatggtatcagctgctctttgtacctctggtagaattcggctgtgaatccgtctggtcctggactttttttggttggtaagctattaattattgcctcaatttcagatcctgttattggtctattcagggattcaacttcttcctggtttagtcttgggagggtgtatgtgtccaggaatttatccatttcttctatattttccattttatttgtgtagaggtgtttatagtattctctgatggttgtttatatttctgtgggataggtggtggtatcccctttatcattttttattgtgtctatttgattcttctctcttttcttctctattagtcttgctagtggtctatcaattttgttaatcttttcaaaaaaccagctcctggattcattgattttttgaagggttttttgtgtctctatctccttcagttttcctctgatcttagtgatttcttgccttctgctagcttttgaatgtgtttgctgttgcttctctagttcttttaattgtgatgttagagtatcgattttaggtctttcctgctttctcttgtgggcaattagtgcgataaattataatttagtgctataaagatctgttgttagtctgatgggcttccctttgtgggtaaccagacctttctctctggctgcccttaacattttttccttcatttcaactttggtgaatctgacaattatgtgtcttggggttgctcttctcaaggagtatctttgtggcattctctgtatttcctgaatttgaatgttggcctgccttgctaggttggggaaattctcctggataatatcctgaagagtgttttccaacttggttcccttctccccgtcactttcaggtacaccaatcagacgtagatttggtcttttcacatagtcccatatttcttggaggctttgttcatttcttttaactcttttttctctaaacttctcttctcacttcatatcattcgtttcatcttcaatcactgataccctttcttccacttgattaaatcggctactgaagcttgtgcatgcatcacatagttctcatgccatggttttcagctccatcaggtcatctaaggtcttctctatgctgtttattctagttagccattcatctaatcttttttcaaggtttgtagcttctttgtgagggattcgaacatcctcctttagcttggagaggtttgttattaccgatcttctgaagcctacttctgtcaactcatcaaagtcattctccatccagctttgttctattgctggcaaggagctgcgatcttttggaggagaagaggcactctgatttttagaattttcagcttttctgctctggtttctccccatctttgtggttttatctacctttggtctttgatgatggtgaccaacagatggggttttggtgtggatgtcttttttgttgatgttgatgctgttcctttctgttagttttccttctatcagtcaggaccctcagctgcaggtctattggagtttgctggaggtccactccagaccctgtttgcctgggtatcaccagcagaggctgaagaacagcaaatattgcagaacagcaaatgttgctgcctgatccttcttctggaagcttcatctcagaggggcacccagctgtatgaggtgtcagccagcccctactgggaggtgtctcccatttaggctactcagggtcagggacccacttgagtctgtccattctcagatttcaaactctgtgctgggagaaccactactctcttcaaagctgtcagacagggacatttaagtctgcagaagtttctgctgccttttgttcagctatgccctgccccgagaggtagagtctacagaggcaggcaggcctagctgagctgcggtgggctccactcagttcgagtttcctggccactttgtttacctactcaagcctcagcaatggcggatgcccctccccaagcctcgctgcctccttgcgtttgatctcagacagctgtgctagcagtgagcaaggatccatgggcatgggaccctccgagccaggcacgggatataatctcctggtgtgccattttctaagaccattggaaaagtgcagcactagggtgggagtgtcccgattttccaggtaccatctgtcatggcttcccttggctaggaaagggaattccacaaccccctgcacttccctggtgaggcaatgccccaccctgcttcggctcacactccatgggctgcatccactgtccaacaagtcccattgagatgaacccagtacctcagttggaaatgcagaaatcacccatcttctgcgttgctcatgctgggagctatagactggagttgttcctattcagccatcttggaacccaaccccgttttgccaaatttttaaggtaacgttcatgggttccaaggattaggacatggacatacatgggtgtcattttttagcctatggttgaataaatagtgctgtgaaaattggctattcatttgaaaaaaaatagataactgacaaactatatcagaatcaattctagactgattaaaataagggcctggtaactttttctgtaaaaagaacagggagataataaagagtttggggtttgcagaccacgtggtctctgtcataatgactgaactttgcccttatagtgcaaagcagccatagataatacctacacaaatgggtgtggctgtgcctcaataaaattttgtgtataaaagcaaggaatggaccagatttggtccatggctcatagtttgctgaccctagttaaagacagacacaaatgtgaaaaaaaagaaaaaaaaaaaacaataaaagtaccaaaaaacaagtaggtaaatttttatatagtctttgtacagaaaagagttgataaacataaaatcaaaggcagaaaccataagagaaaatatttgtagatttgccatcacaaagattggaaaactccatagaagtactaaaagataaataacgtgtgaaagaaaccggttctttgtacctctatcaagaattttacaaagagagctataagccagaaagccccaattgggatctcaaaataagctgaaaaagttaaaattgaggagactgtttcagaaagaagtatattctgcctttctgccacaagtaaataccagctatgtgtacacaaaatagaagcgaggccatgtgtgtcttaagtccaatgaagaaaatggaatgagttttagttacatccccttgcaggccccagtttcatcatctctaaaatgaaagtaacgatcccagtctttcaggcttcacagggtggttgtgagagttaaatgagagtaaagaatgggaagcagctttgaaaattataaagtgccaggatctaggtaaaatccaattttgacaaataccaaatataatacccaattcaatgatactctttttccatgaccaggctgaaagcaatactattaatagtattgctttgatgatgcatatggaagaattctctttgaaggaaaaatcacaagcttctgcctatgtagctttccatttacttaacaaagttgagtttcttgtggtactcaaaaatgtaaaaaatgaaaatctacaccacattaaccatttagtaacctaaaagaagactactactgaagcatgagggtggccaagggggagagttgaaaaacaggacagaaggtgttagcaggaagctaaatagcacctaatagccatgctataaatttcggactttaccttagaaacaacggaaagccactgaagagttttgagcagcagcacaatataaacagatttgtgtttttaaaagatcaacttggctccagggcaaagaatgaattggaaagaacagaagtggcaactagaaagtaagtttaaaagcttacacaataatccaggcataagttgaaggtaccataaactaaggtgacagtaatggagatagagagaaggatatgggctcacaagttatctaagaattaaaatcaacaagacttagtgatggacatgataagaggaatgataaaggaggtatcaagaatgacaaccaggtttctagctgagagattattggaaaacggtaaacaccatcccatctttagactaataatgggacaacttcaccaaatcaaaagtgtaaacaaataataacaatgataataactgacatttattgagtacttgctcaacatctgccattgtggtaagtacattacatgttttgtttcatttaaaccacataacaaatatcatgagaaatgtcttaaaataatgtccgttttatagatgtgggaactgaaacactggggagttttttaaggtccactagctagttcacggtagagatgggatttggaccacgcagtccacttcaagagcccaggctcctcatacttactcagaggaagatgagtgagtgagtactctatgacggagcaaagtcaagctcatctagagaagatgcagaacgccagcaaagatcctcacaacctagcaggaaaatggaaactacagaaagtttgaaaggaagagatgaaccttggagctagttactttcctttgagaagctttgtgtcaagatgagaggcttgaaatcctcgtgtgtctaaaatacgatacagagtcagttatgaggtttgctttggtgactgtgatggttaattttgcgcatcaacttgactgggctatggggtacccacaactttagctaaatgtaaattgttcttcgtgtgtgtgtgtgtgtatgtgtgtgtgtgtgtgtgtgtgtgtaggtatttctaacgtaattaacatctgaatcagtagactaagtaaagaagattgccttccttaatgtagatgagccttatccaatcagctgaaggcctgaatagaacaaaaaggctgagtatgaagtaacttgaactgagacattggtcttatctggtcttcaaacttagactgaagcataggttcttcttggatatccagcttgctggccttctgactggaacttacaccattggtcttcctggttcttacgcctttggacttggactctctatctgcttctctttttctctccctccttctctctcccttcctctctctctttttatctctctctctctttttatctctctctctctctcaaatggcttatgactcaaatggggcgaaagttaatcctgaggcttttgctcaagtttttcattcacttattcaagcaaatattttttaaagcatattatgagtccaggcactgttctaggcaatgcagattaaaaaaaaaaaaaaagtaaagtgcttgccctcatgatgtatatattcttctgggagaggtaataaaataaatacaaaaaaatgtgaaaagtaaaccttacataatacattaaataatgttgaaagctaaggagaagaaaaccgaaggagcaatgtcaaacggtgatggggaaatgttgaaatttgctcagaagttaaacagccattgggaaagaggcattccctttcatctggagtcacaggactgccatttctgcctccatgagggcagagtttgactgaaaatgaagccagctgaggggaaagcagaaccaagagtcgcagagaaacaaaatcttaatgacttcattggagcacctggactcagctgtgcctcaagttttttcttttcgcctcaagttttttattttcagttatatgaggcaataagtgctcttattttttgttcgaattgggttttctgtcacttgaaaccaaaaaaagacctgactaatgccgacactttcaagtatatatagaaacttgaagtaccttacaatgtgtttctaagtggggttcctgctgtacttggattattgaatagctagaactcatttctaattagcagtatacatttacatgcaaacacctgaaattaaaagaccttaaaaacagcatgttcacttaaatgtgtttaaacaagtcccctaaagtgtggtttatactattaatttaaggaaccctttcttaaagattgttccaaggttactcttgtccagatcaatgagattttagcagacacatatctgccactgtaaatagaatggttatacagtgtttagacttttttgaagtattgttagacagaacagaaaaaaaaccttattttttgttggtggtgttggttatattttagaggacatagagccaagggtcagtctccatctgctcaaaagagagaaacactcatcagtcactggctgtcctaccacgctagggttccaagtatgccaggaccatgcttgctgatgttaactcaactgtgtaattacgatctgccacaacatgccagctgaccagaaccccaacactgaattaaagctcatttaaatttaagagtagaaaaaggaataaatacttttttaattttcctcatcctcctttctccattcttcccctctatttaatcctccttccttcccagtcctaaataaaaaccaacaaaacaaagccaaataacaaccgcaaaatgacagtggctctccccttcaaccccacatccctctagggcaccctttttacatacatagcaggttgttgggtgggacttctgctcctctagaacctaccaggaggacacatgcataggatcaggagatgataagcaccccacattatagggaagccacagacagggagaaaacatctccttggggcttattaaagaaagctaatctaactctgccacttttgccatccctggagcagagtccactccatcatttatgaatgaccaaaaacaaggagattcaaagaaatcctgagagatggggatgagccatcagcctgggtgagctaaccctggcctttcctccccttcctatagagcgaggtgtgaaactacttctctcttattaagcaaagaaagagggctgcataagtatcaatcacagagtgacctgtaagaaggggagactggcttcttttcccaggtggaatgtctgcatatgcagcctatttgctcagctgctcatgcttatctaagcaggggaaacaattagagaaagagcagagcagagaaaggggtgataagtgaaacatctttcatgtggatttgtaagtttcctctggatagctgaattgtagggaagatagcttggcttgaaccaactttctagtactccaccaagaccaacccccaaggtggatgctaacggattgaaaacccaagtggggcttccacattgagaaactgtgcagtggaaaagcctcctacaagactccagtgatttcatgcaggcatcttaggagggagactcaatagtcagcaattattattcagagagagagcaacacccaacagaggatataggtgcaccgttaagtattaagcttgttaaacctctcaccttacctcttccacctgccccatactgacaatatgaaataagaaggattagaggaagagtgagggagcagaccctaccatcccaagtgcctcaagttgaagctttgtgggtgaggaaggtaacattaaatgaataggagactgagtttttaaactagattaatcaggactggcattttcaatatctgaaatcaactggaaagctattggtaaccaaggtgtttttaaaggacaagaaaaaggatccatcagaatacagacgaaggtagtgactaaagaaaaataaaatctattctgagtcagacttctgtctgaaaggtttgcatctaccaaacatccctaaaattgtgtcggttgcatttgctcaggcctgtggcaaatttacacaccacatcagctcaagtttcccatgaaatcacaggtaatattttgtggtgataaatgcaaggggaaagcagaagtgaaaatgtggcttgagcttggacagtcagagtgcactttccccctgggcaccatgtatagtccttagtctgctaagtaactctagcggactttgggaggcctcccctggttattttttgaaaagaatacagtgttcctttctttggtagtagaaaatcaaagtccacatgaaatcaggaagtcccaataaccatagagaaggcagcaataaggagtaggagagagtgaagtcaatacatgcagagacagccagggtaagggactgaggggtgagtcctgtggacattcggacccttgaagacagtcacgtctaaggccattgtctttctctccatcctgcgttttgattacaagaattcataaatccttggttctaagtttgtttccagtgggcttctgtcccctaaaaccaaacaatttcagagtaataaagctacatataaaaatgccatgtcatagctctggtttgtatctagctcaagggaacgagagacagaagaaaagggaggagtcttggtctagaagaaataggtaaggaaaggggcaagaggagacagcattggagactattaatcaggtgacgagagagtggagatttaaaaatatattgttggataagaggaactgttatgacatgaaaatgggctctagaaagtttcaccctacatcaaagaacagactttatagaaaatgtcccagagctaaatcagtcttggggaaacaggaatcatgcagagaggccctggacacctcaaaaggatccatacaccacagctaaaagaatgacctagtagagttttttaatcacagttttaacagtggaactctttcttctaacaaactgttactttgaacacaaatatataacagataaaagcaataaatcaattacttgagcaatttaaacctttattacttgacctccaatattcattgtttagggaacccctaaatcccctccaggaaacatttggattttgtggagcacaatgtgaaaaccactgaccggaaacacactcccacacatgtgcctgttccacacactttataccatgcttaaagacagcctgatactctagcaactatgaaaatagtgcatattacacagtactcatagcaaccatggaatttacatgcagacacttggcattttcagaaggaaaacaaaccatatctaagcttgcttatttagaccactgcttttatttattcctaccaaattcttatgttccttgcaattgcactcgtgctttcttcaatcatgccccacatactgctttttctcaggaatttccatgtatatttaatgcctatatcttgtaatttcttgaaaaggacaaagacagaagtccagccaaggccatgagactgtttttctcctaagaaactgtcagccaaatttctcagggagaaactggaaatgaagtgagagacattgataaatttccctgctgaacaatcaataaaagctccaccatcctgctcagattcccactgtggaagcaagagccgtaattacgttgtcaaaaatttaagttgcccaggctgacagcaacccacttgaaaagtgacaagtgattggcactcagtttggagtggtgaacctggattggcagacagagtgatgaaagcaaaaggcaagagtgaaatttccttattgactacagctacccaaaccccagactgccactcaggaggaatcctgagaccctttagtcatattaacgcatcaaagtgagcagctgacagaagttactaaacaatctgaactccaccagcaactcagaacctgtcctcatctactctcaaacagaaacagaaaagatggtgctgtgtgtgggtgtatatgtgcagctgtgtgtatatgtgagtgtataagggtgtgggacttttcctacattcaaagaaatacatgtaacgtgctttcaactccatcttgccttgtgacagctgaacaccaaagcctgtttgcttagcgattttaatccaaggtaaaaatcagctggagcagaagggtttcaaagagcaataataaagaatgagatggaaggagaaggtgggaaagtgatcggactgacatgcagaccatttgtgtgattctacatgacctgagctggagttaaattagaatccattcagcattgctgctgaatattaggaaccaaatgtctgccaagggcctcattcgctgggcagtgccctgcttcagactatactgggacccatgcaaatagtttctaagaagccttttgtaaccacgcccaggaatggtggttatccacagctgggaagcagctgcaccaagagagattaaaatctaaaggtgttgactgggtggtgggaagagaagagaagatgcctgggaatgttgttaccacatgatctccaaggttaaaacccttctgttactctgatgaaaagagatagacaagaaaattaatatgtgttttgtgtgcccaacactctggaacacttcatgagcaataagtttatgaagtgggaactgtgtttttctgattttttagagatctgttgaaggtcatagctgatctgtggcagaactgggcccatttctgattccaatttgattaaccacttgaaccagtgtttctctgagtatagtcaataggccacctgagtcacatcacatgtacatttccaggcccagaaatctagatttacaaaaacctctcccaaaaggctcttctgtgcgccaaagttggtgaatctcctcattatgttatcctgggaaactgagtgaatgctgggtcattagggacttcctgggtgcaaaacagtgaatcaagttgctcactattttgcatacttgatggtgaaagaaaattagctttttcctaaagccccagtgtcaccagacccacctctggccccggcaaaaggccagtgaaattatgaaatgactttagccatgatataccaccacgctggaggggaaatctgtctgagacctcaggtggtgagggagaagtgacaggagagaattgatgagctgcacgtggggctgcgattctctgacagatacatcaggaaaggaatccctgtcacccaaatggctgagctcttttctacataatatttgtttcaaatgcatgagatgctgcagcatcacatcagagaggaaatggcttgatctttgcctgtgttcaatgggcaagctctgtgattcaggtgagatcctagtcaattctctgtcctaaatgctttggggaatgtttaaccagttttgaaaatggcctaatctgggaatataggaaaagggggagagagagagaggagggagaaggagaataaaggagagggagggaggagaggaagggaggaaaaaggggagagagagagaggagggagaaggagaataaagaagaaagagggagaagaggaagggaggaagcatggagagagaggagggagaaggagaataaaggagagggagagaggagaaagaggaaggaggagatggaaatgaggaaagcagagggagaggaggtctcattctcaatatccagtaacatcagatggctgaagtagcaacattttttctgaactttcagaattttcaaaccatattagaggcatatactttgcttgaattgccccatattgactgtaagcaatgggactagggattttcttgacatttgcttaaccacaaaggcttacatgcacaacgtacatttaaaatacaggcacaaaaggtatatttatgagttctttctttgattcttcacaatagagcatgataattagatgagcttggaatgaaagaggcagaagaaaataattaggagagttttcatttttcctcatttgaattcctattttcaggaagagctgtgctatctgcatcatacaggacagtggctctcaaatctgaggattcctcctaagcctggggtcctctggacgatctatgggctggctgaaccacaaatatacaccaacttattccccagatgcacttttttactggtaaaaagcaacatattgggttagtggcttaagaggccattgagctagagcaaacatttgaaaaccatggctgacgtgggaatagatcctgggctacaaaatcaatgtagttgcttgctgatgaagataggaggtaaaaaggtccccttggaagttgatcatagaatcaacatagcaagcattttgaatttctatccagtgagttatggggtatttttaacctcacaaaatttgatccccagtgtctagcacactgggtagcccacagtcaacacttaaatgcttgaggaaaagatcttgcttcctttcatagtaagccaaaagagacacaagcatgttttttgatagacaatgattggggcctgtggtcggtatgagacagagtctggataaagaaaaatggcagattcctcagcacagctccatgccctcatctagagcaattatcctatgacaagtggattattttgtgatgccaatatagaaatatcattgtgtaactgacattatgatttctggagattgagtcactatctggagcccacattttttatctgcctttggctcatgctatgcaaccaaaagcatataaacacccactgaaatatgcttactcattattttatactgatattttacagttgatactaaggattatcctggcacacctggtaatttcctgactctcaagagggaaaaaaaatgtccattttgcaaagtggaattagatgatcagaaagcaaataaagttggagtagaacacactgtagcctaatctattttctcctgggaatccttaaacaccccacctatctgtaagaggattctaagtagaactgtaattaaaccctgctcatggggtagagggtttggggagacaggaagaggttcaacaactaaatgaggttgtctgtatttgatttgggataccaggctactgcatgttgagagacatcagtacatgctaagtaattgtatcagtcagttttcactaggctatgctgcaattacaaatgcaaatttcagtggcttatgacaaaggcttatttctcactcacatacatgagagcagtaggtcagctgcagcactgccccatgtcgtcttcgttcaggttctaagcagaaggaactgcctctatctgggacaggctattctcaagtggcaggaagaaaacgaaatggctaaagcatcgtaacaggtcttaaaaccttcacttggccatgcagtcccccagttctgctcacattccactgaccaaagcgagtataaggctaagtctgctcttgcaaaggggccgggaagtatggtccacccacaaggaggcactgaaagtcacctaacagtgggtggaagtatacacaatcctcttacagaaagaggagcaaacaattgggaacggtagtgtactctgccacatgaatcgtaacagttttacttgttatttaaggaaatagtgccatgctctaactgacctggttggctcagcaactatagtcaaggacttttaaacagttttatcagtttccactgctagacacagctctacttcatttcctctgatcaattgcctcactcaccgtgcagagaaagagttccattcctcacagccaggaacttgactccatagggaaagaagggagttgagtaggaactcccgtagagtgtgatctgagctctgccttggaagggcttgtcttcggatccaatccggagctctccaccatcagaaacaaggatggcgtgtgccctgagctcgatgggtcctggggccatgaaaatcagcttgccccctaatggacaaagggaaaattgtcagtccctgggaggataaggcttaccgttttgtcagtttcaatgcctgatgaaatccccttcatttaaatacttctgctggaatgtagacttattttatcatgctctctcttgtagaagcacagtagggtagaccagacattcaggagtggaagcactattatttagccagtttaggttagctattactattctctgctgctttattacattttcatgacaataatctaaatgtccagcaatttaggaatggttaaataatgtatgagaagaccactaactttaccatttaacaatagataaaattaagaaaaaaaaaaactgggacatatacaagaaatagggctagaagaagatgtgccaaaattgtaagaattatagtaaaaggaaatgtaactagggctaacactgtggcatttgtagcattttagctgaccagcatccattatactttcttttgttaacagaccctaatttccttgaggtattgctctgccccattgactagagctgagtggaactgtcaagcaagacatcttatcctaccatggccagagtcacatactcgggctttaagagaaatatggagcaaaagggaaaagaggtaggaaatatttagatctcagttccagtggtggcattctaaggagcctgggaagaacacctgcttctgagatgcccacctgcccatctccctgcctgccccaccacccgccacttgcatcaaatgctttgattcctacgtatttctgtccctgatttttcagactgctttccactgattagtaggttacccaataccttcccaatacattccatttttaaaagaaaagttgggttctcttattggcaaccagataaccttaactgatacatataccattttgctctgatgtccaaattttcagtaacacaagaatattcgtttataatagaattattttgcattgtgagattaaataatttaaaaattaaaaagatattttcatttttataatatctttctttaaaaggctttagaatgtttatattttacgtagaattttctcaataatgtcaaaataattaaagcatcccatatgaataaacactttaacttcaataagctatttagtccatctttctcctgcaagtggtttacaaaaataccagactagacccttccatcctgtaacaaagtagtcagaattgtatctttatatcagacacaccagaggtcctcttttctaaatccaacaatagtttcccatctcactcagaatagaagtcaaagtccttacattgggctacaaaaggtccctcatgatttgctacccaacctccaatacctctctaatatcattttctaaagctcacctgttcacacatatgctacaaacatattggcctgcctgttagttctcaaacaggcctcagggcataagctcttccctctggaaggttcttttgatattcccgtgaatatcatgaataagaattatcaaaaatatcggaaatatctaaaatgttattggaattatcggaatgttctgatattcccatggctcactctcccttgttactattcaaatgttaacttctcaccaaggccttccctctccagtctatataaaatagcacaccctagccccttgcctaaatgcctttttctttgtaatacttgatatcaggcatattatatatttacaggtttattttctgccctctccccaccagaatacatgcttcctgaggggaattatctgttttgttcacttctaaattattggtgtctagaaaagtggctggtaggtagttggcactcaacacacaattaatggttgagtgaatgaatgaatggacatatctttttggagattctgatttaagtgcctctatttccttatatacaaacacacacacactctcccattttctcagaaaggatgttgttcttacacttaatttataagcctacatagtgtctcaatgagcaaaggggggcaaaggatatagagatagcaaagtatcagaaatgcctcaaaaggcagattctactataataagaagagtcttggtgagatgtagtggagggcaaagactcttcatctgctaatgtagtcataaatccagagtgccaagttattgagttgagtttttgttgctttccagaaatcacagctggaagtagttaaacatgcactggagaaatgagagggagagaggaaaaaggcaaaaatgactttagtcattatcatgtaaaccaaaaataaaattttaagtcccccaaaccaactgaattgacccctcctcttaggcaagggcgttacaaagttaaactgtaaaactagttcaggccatgacggggagtgtcagagatgcctcattataccctcctccctttggaattcagaaataagtaaccagcattaacattaaaacagagacattaagactgacaaaatagactctgtagcaataagacaccaaattccaacctgactctagtacagcaccacatgacagatagccggccctgaaagaaactgaagtattttaccccaaaatatattaaacggccctgcaaagctgtctcttgtggggaaaatctacattctgtagaaaattcccttccttttctggatctttaccctgagctaggagagtgctaactaagagtctggaacctttttagatctgctaagaaacatttacagtctattctctctgaagcctgctacctggaggcttcatctgcataataagaaccttggactccacaaccacttatcttaacccagacactcccttctgttgattccaggtctttagataagttaataagttaactctttcaaccaattgccagtcagaaaatctttgaatccatctatgacctggaagcccccactcctacttgtctaacctttccagaccaaaccaatgtacatcttatatgtattgattgatgtcttacctctccctaaaacatataaaaccaagctgtagcctgaccatcttgggcacatgtacttacgacctcttaagactgtgccccaggccatggtcactgaaatttggctcagaattaatctcttcaagtattttacagagtttgactcttttcatttaattgtttacctccgtcttagtgcagagacagtgatcaataaatgtttgactcaatagtcaaatatggaggccacttcttccctaacttctcttcagctttcctcagctcctttcctcaagactcttttcttcaattctaaagcccaagccatatgccatcagtaatagtcacgggatgtatacttggaccagaccccttcaaggaccttttctttcagtcacaatttagaatgacacaccccgcataggtatccagtttctccatctgtaaaatgggcatggtaagaatttcaccctcagaagattaaggtgagatttattgaaatagttcttatagatccctggtctggagtctgacacctattcaacccttaatgcaatggtctctgtggctatcatcacactcaccatcttcgcttcctccattattgctgtgaaaccatccttgcaaagattctgacagtgagaaaaatctaacatggcttactccatcttgttcctagcctcacaggctggctggctttgctcattcctaggtgtaagccaagctaactatgggaggaatttagtttatagtctaaccttaaacaaggatgataatagcccttcccaaaattaaactacctttgtaaaactaatgaaaggccacaaggctaggattataagaggtgccaaaattctaagatgtttagcatatttaaatgattactagccattgttcaagaggtcacaagatttgcaactcttccaaatactccaatagataacatcactattttagaaactgtcaggcctctgagcccaagctaagccatcatatcccctgtgacctgcacgtatacatccagatggcctgaagtaactgaagaatcacaaaagaagtgatatttaaatggcctgttcctgccttaactgatgacattccaccacaaaagaagtgaaaatggctggtccttgcctaactgatgacattacctggtgaaattccttctcctggctcatcctggctcaaaaagctcccccactgagcacgctgtgaccccccactcctgcccgccagagaacaacccccctttttcctttacctccccaaatcttataagatggccccactactatctcccttcactgactctcttttcggactcagcccacctgcacccaggtgaaataaacagccttgttgctcatacaaaacctgtttggtggtctcttcacacagacgcaagtgaaattttgctgccatgactcagatcagggaacctcccttgggagatcaatcccctgtcctcctgctctttgttccgtgagaaagatccacctatgacttctggtcctcagaccaaggaacatctcaccaattttaaatccggtaagcagcctctttttactctcttctccaacctctctcactatccctcaacctctttctcctttcaatcttggtgccacacttcaatctctctcttctcttaatttcagttcctttccttttctggtgatgcagaagatgcgttttatccatggacccaaaactctggcgccagtcacggactcaggaagacagtcttcccttggtgtttaatcatgcggggatgtctgcctgattattcacccacatttcagaggtgtctgaccacgtggggatgcctgccttggtccttcacccttagcagcaagtactgcttttctggggggcaaggacccccctgaccccttctctccatgtctctaccccttctccacttttctggggggcaagaacccccccaaccccttctccttcacccttagtggcaagtaccgcttttctggggggcaagaacgcccagaccccttctctccgtgtctctaccccttctccgcttttctagggggcaagaacccgctgaccccttctctccgtgtctctactctctcttttctcttggctcgcctccttcactatgggcagccttccaccctccattcctccttctcccttatcctgtgttctcaagaacttaaaacctcttcaactcacacctgacctaaacctaaatgccttattttcttctgcaatgccacttgaccccattacaaacttgacagtggttccaaatagccagaaaacagcattttcgatttttccatcctacaagatctagataattcttatcgtaaaatagacaaaccgtctgagatgcctgacgtccagacattcttttacacattgtttcctccctagtctctgttcccaatgcgactcatcccaaatcctccttctttccctccctcctgttctctcagtcccaaccccaagcatcactgagtctttctaatcttccttttctacagacccatctgacttctcccctcctccccaggctgctccttgccaggcccagccaggtcccaattcttcctcagcctctgctcccccaccctataatccttttatcacctccctcatcacaccaggtctggcttacagtttaattcctcgactatccctcccccacctgcccagcaatttcctcttaaaaaggtggctggagctaaaggcatagtcaaggttaatgctcctttttctttatctgacctctcccaaaatcagttagcatttaggctctttttcatcaaatatgaaaaacccagcccagttcatggttcgttcagcagcaaccctgagatgctttacagccctagaccctaaaaggtcaaaaggccgtcttattctcaatatacattttattacccaatccgctcctgacattaaataaaactacaaaaattaaattccggccctcaaaccccacaacaggacttaattaaccttgccttcaaggtgtactataatagagtagaggcagccaagtagcaatgtatttctgagttgcaattccttgcctccactgtgagacaaaccccagccatatctccagcacacaagaactccaaatgcctgaaccgcagctgtcaggggttcctccagaacctcctcccccaggagcttactacaagtgctggaaatctggccactgggccaaggaatgcccacagcccgggattcctcctaagccatgccccatctgtgtgggaccccactgaaaatcggactgttcaactcacctggaagccacttccagagcccctggaactctggcccaaggctctctgactgactccttcccagatcttcttggataagcagctgaagactgatactgcccgattgcctcggaagcctacaggaccatcgcagacgctctgggtaactctcacagtggaaggtaagtccgtccccttcttagtcaatacggaggctacccactccacattaccttcttttcaaggacctgtttcccttgcctccataactgttgtgggtattgacggccaggcttctaaacctcttaaaactccccaactctggtgccatcttagacaacattcttttatgcactcctttttagttatccccacctgcccagttcccttattaggccgagacattttaattgaattatctgcttccctcactgttcctagattacagccacacctcactgctgccctttaccccagttcaaagcctccttcgcatcctcctcttgtatccccccccaccttaacccacaaatataagacacctctactccctccttggcgactgatcatgcaccctttaccatcccattaaaacctaatcacccttaccccactcaatgccaatatcccatcccacagcacgctttaaaaggattaaagcctgttatcactcacctgttacagcatggccttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccagcccagcatggccttttaaagcctataaactctctttacaattccaccattttacctgtcctaaaaccagacaaggcttacaggttagttcaggatctgtgccttatcaaccaaattgttttgcctatccaccccgtggtgccaaacccatatactctcctatcctcaatacctccctccacaacccattattctgttctggatctcaaacatgctttctttactattcctttgcacccttcatcccagcctctcttcgctttcacttggactgaccctgacacccatcaggctcagcaaattacctgggctgtactgccgcaagccttcacagacagcccccattacttcagtcaagcccaaatttcttcctcatctgttacctatcatggcgtaattctcataaaacgtgttttccctgccgatcgtgtcctactgatctctcaaaccccaccaccttctacaaaacaactcctttccttcctaggcatggttggatactttcgactttagacacctagttttgccatcctaacaaagccattatataagctcacaaaaggaaacctagctgaccccatagatcctaaatcctttccccactcctctttccattccttgaagacagctttagagactgccccaaccttagctctccctgactcatcccaacccttttcattacccacagctgaagtgcagggctgtgcagtcagaattcttacccaagaactgggactgtgccctgtagcctttttatccaaacaacttgaccttacagttttgcctagccctcaagtctgcgtgcagcagccgctgccgccctaatacttttagaggcccttaaaaccataaactatgcttaactcactctctatagttctcataacttccaaaacctattttcttcctcacacctgacacatatactttctgctccctggctccttcagctgtactcactttttgttgagtctcccgcaattaccactgttcctggcccggacttcaatccggcctcccacattattcctgataccacacctgacccccatgacttatctctctgatccacctgacattcacccccatttctccatatttccttctttcctgttcctcaccctgatcacacttggtttattgatggcagttccaccaagcctaattaccacacaccagcaaaggcaggctatgctatagtacaagccactagcccgcctcttagaacctctcatttactttccatcgtggaaatccatcctcaaggaaataacttctcagtgttccatctgctattctactactcctcagggattattcaggccccctcccctccctacacatcaagctcggggatttgcccctgcccaggactggcaaattggctttactcaacatgccccaagtcaggaaactaaaatacctcttggtctaggtagacactttcactggataggtagaggcctttcccacagggtctaagaaggccaccacggtcatttcttcccttctgtcagacataattcctcagtttgggcttcccacctctatacagtcttataatggactggcctttattagtcaaatcacccaagcagtttctcaggctcttcgtattcagtgaactaatagtcttttaaaaacacacctcaccaagctcagccaccaacttaaaaaggactggacaatacttttaccacttgcccttctcagaattcaggcctgaactcggaatgctacaaggtacagcccatttgagctcctgtataagacgctcctttttattaggccccagtctcattccagacaccagaccaacttggactgcatcccttccaccaaaaaaaaaaaaaactcatcatccctactatcttctgtctagtcatactcctattcaccgttctcaactactcataaatgccctgctcttgtttacactgccggtttacactgtttctccaagccatcacagctgatatctcctggtgctatccccaaaccaccattcttaactccctcttaaagtaaataaataatctttgctggcagggctatgctgaacctccttaagcactctctagttagatgtcctggatcctcccaattcttaatcctttaatacctgcttttctccttgtcttattccattcttttttcaattcatacaaaaccatatccaggccatcaccaatcattctatatgacaaatatttcttctaacaaccccacaatatcaccccttaccacaaaaccttccttcagcttaatctctcccactgtaggtttccatgccgcccctaatcccgctcgaagcagccctgagaaacatcgcccattatctctccataccacccccaaaaattttcaccatcccaacacttcaatactgttatgttttatttttcttattaatataagaagacaggaatgtcaggcctctgagcccaagctaagccatcatatcccctgtgacctgcacgtatacatccagatggcctgaagtaactgaagaatcacaaaagaagtgatatttaaatggcctgttcctgccttaactgatgacattccaccacaaaagaagtgaaatggccagtccttgcctaactgatgacattaccttgtgaaattccttctcctggctcatcctggctcaaaaagctcccccactgagcactttgtgacccccactcctacacgccagagaacaacccccctttttcctttacctccccaaatcttataaaacggccccgccccatctcccttcactgactctcttttcggactcagcccacctgcacccaggtgaaataaacagccttgttgctcacacaaagcctgtttggtggtctcttcgcatggatgcgagtgaaaaacactaagattggtcttttgagatttttttttaggcttttgtatttctgaccaccagctgacttcactcagattcatgacccaagactcaaccagtgctgtggcccttacctaaagacagactcagtacacaaggactgttttccatacccctatgatttcatccccaacaaatcaatattccccataccctagttccctgcccaacaaactacccttgaaaacccctaacctctgagcctccagggagattgatttgggtaataaccccatcccccaaatggtgtggagggccttgcatcagttaaatgctttctttactgcaacgccatggtcttgacgaattgattttgtctgtgcaactggcaggaagaacccaccgggtgattatatctacaacctgctcaatttctacaagtgccctaccacttgagcactgctagaccatctgcatccaacatctctctgttactggtccttttgaaatattttgtcatatataatatttcatactctagggtaaagcagcaaggtcagtctacaggctccatgccagagcagtaccacactgcttaccagacttccaaaggattccctaacaattttgacttttttcctttcattgtcattacatagaaatgcagtaataatcatgagtcccagtgtgagcaagaaggaagaaatatgacctgggctacagatcaaattttatgttaactaaaatttttccctcacagccacatgtcattaacatcctaaataattatattcaactggtagaacatggatttgtatgacaggactgccgcattgtaaatagtcaggaaatctaaactgaccttgatgagcaagtggtaaaggcagggaacaaaatcaaggttcctgtcctgagtctgctattgacctctgaatgagcctcagtaagtcccatacaattgctgggcctcagattactcaggtcccaaatctctcctactcagtgcctattaatggtctgtggtttcatccgcaaagtggaaggtggaattatgagttcctttcaactctagaacacttgacgtctacatctttatgaatgcagtcagatgtgcatgggacactaatggaggcacaaggctcatgttttcctgacactgcctgtgctgcagtaatcactgaattttttcttaagcaagatatgagatgcatagtcaggaattcatataagactacagggaaaacaagaaagctaacatttattcagcacctaccatgtaccaaaatctgtagatatattgtctaaaatgaccttcaaaaccagtctgtgagatcaagatcacattctttatttcacagagcagaatgtggctaagaggcattcatacctattccagcccagaatacacagaaccaaactagaacccaggactacccaaccaaaaggctcagatcctatccatttgcacaaaccttccccagtagctctcaattcactagggttgttctcatagttacatttaaggaaaaacatgtgtgaacctaagaaagtttgcctatggcttgtttatacatgatttattttaattttgttaatgaagatataccttgtctttttccaaaaaggatttgaaacagattacaaggattagtgggtaaatatataaacatgggctttgtcccttttaccatgaagcaaaatgttaaatacactgaaacaaattggtagaaattttgaaacatcatttactgacaggaactaataatgatgctaatgaagggagaaaaactcatcccaaagaaaatgaattatctgcgttgtcaggagtgtcataaacaggactaattaattaatatgaacatcattaactcctgctaaaaagcatccccaccccgctttattagtggcaaatataagaaaatctaggtacatttagaagaaagtttgatgaggaattcagctatttttgcctgaaataattagataaacaaatgaaaccttctttatgtgaaagaagataaagtttatacttaatctatctttatgccaaggcaccaagattttcatcctcacactttattagtttaaaataaatatacagtgggctgctttaaaggatagttacttgagtatgggagggctgtgggaggactttattccatactttatagagcttgaccccatttctaaatgctgaaataaagagcagggctgaaatcagcctttggctgtgacccttaaattgcttgttatgactttcatgaaagctgactatgtcccacaagtaaccttgggtaattttataaaaatcaatcaaccatcattattgttacttccctctaaaataaataaatgaacacaactttttatatgtaatcacctctttccattaaacatctcttttgtttcttttaaagggaagtaaaagagacttttagcagctagctaatgtttgcaaagtacatcaaaatctgcttttggctaacccaacaattagtcatcctctataataaccacaaaataatttgttgttttttttaagaaaacaaatacacaattctattttcccccttacagaaaaaatttaagtataaatattataccatacaatactagtcttcaaaagagtggctatacctactatcttcaactctttttcatgactgtcttttgaaccctccctggtcaggcctttacctgatgaacctgcaaaactgctcctctcaaggccacagatggcaaccacattggtgaatctcaggctcaatgctcagtcctcacccttcccgagtgaccagcagcatttgacaacttggtcacttctttcctaaaactccctctcctcacttgcccagcctctttgtttttctttctttcattttctcatctctatttaaaaaatccaatgtttctatacttctatcaaattttcatcatgtgctatattctatacattgtattgaatcgctaaagaaaacctcataaaatgcaaaagtgctagtaactcataaaagaacagaagaataaactcttctatttagaacctttgtctttccttcacctggtatctaatttcatgtcttcatttttagcaaatactaagaaagctccctattgactcaatgacagtgagcacatgggacttttctaattaagtaggttgggtacaaacccagctggttttcctcttacttcttaggcatcctcttctcagcctcttctgcctgattcctcctgatcatcccaaccactgacacttggtgggtcccaagcctcagccctctaaacacgtttcttatcagtctctgtagaccatgccagttgtcccatcttgtcttaaggttttaaacaccatcgcacgctaattgtcaatgactctcaaatttatatctccaagcttgtgccctcagctcaagattcacatacccaactgcctactcaacatctctacttggatgtctcatagtttcttaactatgagtatccatgaactcctttccttgtcttgccccacagatcttccctcagtccttcccattccatgaatggtaacttcatccttgcaattgctaagtctgaaaatcacagagttaactttcactgtctctcactccataatcaatacttcaggaaattgtatgcattccaccttcaaaacgtcccctataacccaaccacttaccacctccacatctacttctggggtccaagtcactctcatctcacccatggattattgtaacagcatcttaacttagctccctgtttctgcccttatcctctacctcagggttaattctcaaaacaacactcagtgttgtcattccttcttttcatgtgaaccatatcgtgttacctctctgccaaaattcttcaatggctcccatcatatttagagtcaaagcctatcaaaccttacagcgttggttctctctggccccatctgcctctgctctcccccttgttccaatactcctttttgctcccttgcctcacaacatttgctatcgctgtgtgccaatatccccaactaccacctccaatgtgtattccctattcacctctcctgctgcatttttctccatggtactaagcaaatttaacaaaaactataattttcttattttgtttattgactgttttccttctagaagtaaacaccatgagagcaagattttggcctgttttgttcacagccatagtccctgtgcctggaacatggggaacgtgttaagtgatcactcaatacttgttgaataacgaggagttgaaattatcaaagtaaatgaggtctcccagggaggacatgtagagtaagaacagaagaaaggtaaggtgggtaaaggtagggaaacaactgtcaaccatcaacatttaaaggctagaataagaaacaagattcttgagagcagatcaaagaattaggtgagttagaaggatcataaggttgtagacataggctcaacgaagagccttaagaactgttaaagaggtagatgagtgtgtcaaacccttaatgccatttttaggaagatcaagagagaaaaggtgcacagccagcatgtacagagttaggatgtgaatgtcaggtgataaaataaacccagggagagtgattctatttttaaacagaggaaaaatgagaggtaaatggaggcaagaccagggagggatctgagaaccccaattcattagattaatctgtatcaccaagctagataattcatttactcaaagcttgaactatctaaatttttagatgtaaactaatttacttgcctacattgattaacccccaattcaccattttttcttaaaaaatttagcagcctatatattcttacctttcaattattaaatagtcaaatggatagtcgaggaagcctgtggaattccctttccctggagaaaaggaatcatccattcaagatggacaaatcctgctctgcctgggtaaggagagctggctgagtgatctgggcagagttggagtatatccctgtaccttactgcactgtgctgctctgggagcaggagccaggagaaggtgaggaagaggaggaaagaggagcatttagagaaggcacccacagcccaaagaaacctgcattgtgacacggatggacacagcttcctttgttggcaagatccggattagacttgtgcctgatccactggagcagagcctgggaagccttcgaggtgggcttgtccccagccagagaggcggaaaatcaatttggctggcaaacgagagcccccaagagcttagtccacgctccataatcctatccactagcagctcaggaaatagatgcctgagccctcacatattcatgggggatgtgaggcataaatcaggctttaaggattgggggcaaagggaatggactctctggctggctactaattaatcaagcacagaatacctaaacctagcaacctgggatggagccacacacacacagaagcagaggctgctgctgctgctgtttttcccatttttcaaaatttcaattaaaatagatatcagaagaaattttcccctttagctgatactgcttatgcatctccctgttcttcctttaattaaaaaacatgcttattgcaatacttgccagaatcactttaacggtattttaattgtaatgtctctgcctgattaaaaaaagaaaatatgaactagaaagtgtttgcaaaaatgttcacaggatgcaggacaagaatcagacacctccccagaatggatgccacatactaattccttaattagcctggtactgcagtcaaatgggcaatatagagaaaaaaaaaaatatatatatatatatatatgaaataaaatcactgactcagagctgcaaacaatagcagttgggagaaaccattttcatcaactcagatttccctggcggggtagggacctgtgcatccaactaaaaatgctgtgctcaagataagcccattcaatgtggccagccaagtttccactgttctttgctaaaggtctcatagcctttgggaaatgagtagttgggccaggctaattggcttctggtcctcacaattccatagggctccttttattgttttaggctagtagttctcaaacttgaacctgcatcagaatcacttggatgtcttaaaacacagactactgggcctcattcccagagtaggtttactgtagagctcccaaatttacagtttgtataagttaccaggtgatgccagtgctgctgactgggggctacactttgagaatcactactatcagtaaattaagtgattgttctaggtgtccgtaggctggtgatgtttggcatcatctgaaacaggctgagaaaatacaagcctggaattatagaataattcccttagtcactcaaccaacatttaccactagtttccagctcctctgctaggtaccgaaataaaaatgtaaaatagagtctccagtttctgaaggtcacggtgaagttgaattgctcctccgggtgaatggaaatgtgttggttttagtgaattgtcccactttagagatgactataagagaatataaagactgtgactcagctctttactttttctacaaaatatgaaactcattaaggtaaccttataactgtattaactctgtactaattacagagtgtaaacatatctgtggaaggcaaactacacagaaatatttaaaggaactcaaacactaagatataagtaaatgcctttgttattatagctactgttatcaattactacctaactaaactttgatttcctttctacatctagaaaaccatgacttattttatcaacaaagcttctagcatttaagtgctcaaggccttcagctgttccatggctttctaaaaagtcacttaaaatctcaagaagaaagctatttctaaggagaaatagaaaagacaaaaaaaaaatcgtctttttcccgaggtctgtaccaagcatgtaaaaatccccctagctactaagttcattcagataatcttcctctttctctttatcaaagttcagttagcactgacccaatctcatttttgaccagcctgcaatttgatacacctctctaagcaacttgttttttcaaaaggttccaaatataattattctctgaatattataaaaatgatttggtatagcataatagtattggaaataaaagcaaacaatacttttcttatagtatttattaattttaaaaatgagaatacagtacttcctacctttacctgaccccaggaatattgtatagaaactataataatgaaatgctcagtccccaacatatttttatctacacaagaatcccaaatacaaaagtacttcagatttctagctccacttccagtccaggatgaataggatatagggatcattaatgaacaaatgagatggagaggtaaagacagaccaagtcctgcatgaccctataagccatattaagtttggacttgaacttacaggctaatggaaagccaatgaaaggttttaagtaaggaagcttgaaacatttatctttcattactgaaaatattatagcttctctgctaggaagggactggtccctttcagtagcatttttcatgttacaatatccaagttgtcaagacataaaactgtaaattgtttaatatctatctatctgtctgtctgcccatctattgaaagcatgtcctttctcatagcaatggcttatctttcatttaaggctaatcaagtgtgtctgggactgttctctggaggtaaataatgtaagtcattgtctgattggaaaaataaggggtctcagagccaagtgtcccccacattaaaaagcctttgtctctgatctcctgatacacaaatagtaaataaaattggtcactgtctggactaatccactaacatttgagggtaccaggaaggactctgattatagagaaattctcaacaaacatgaatctgcctcttcaggtctgaaactcatttattagcttattcattcagccattatttgagtacctgtttcgtgcctggagataaaatggtgctggcaacacaaaggtgagcaaaaacagagctggcccctcctttcttcagcttacagcctagacctttataagcctccaaaatggtagagggaagaaaaaatacaccttgatattctatttgtaaataattaatataaaaataattcaagtttttaaccaattaaaaattctacctgtgatacacttagctttgaatatcagcaaagttcccctcccatgaaataagtaacacctacttgtcaccaagaaaagcccagcacatgaagacacccaagagttaagagtgaacttcaaaaaaactcgggctagttctgatgctaacttcttcatcaggcctcccttctggataatggcacagaccagccccttagggtaccatgcctgccaaatataggaagaaaatttactcattcctatactgctcttcctccacagagttgcacacacacaaacaacattaacatccagtagaggtttatacaagacattttctccctacacagggaagggaatcaccattatttccattttgtgcattgatttgaggaccagagccttacccaaaaccataaaagagtctgtgactgactcaaatttgaagtcaggctccagtttgctgaccaaactgcaatgaatcaaccttgttgtattgtctgcacataagcatcctatcttctggcttgaagggtagctacgttttgactacaaaagagggcaattcagtccatcttcttttacagccaacttgcagataaattattttgaatttaccaatttgcaacaatgtttccagcccacaaaaccctctcctgttgaccaagatattctacagttagagaaaaaaaacaaattattgttgaatatcatatttttatcaaaattactgccttccttcagattttgttttatcctaactggtagctatgaagtcttgaaactataggcagagggtaaaatgccaagtgactcacacaggcctgatgcacaaagagatcacaagcaacatctcaggaaagttctgtgttgtaacatttctagataactgcattggaaagcattatctgaagcatgcatctactgaatctgaggctggcttagtgctaactagaagcaaccaagtatacaatccctgggattaaaaaaaaaaaaggctgtgataggttcatcatttaatacctcactctgaaatcctcaaatgcttgtcaaggatgaaggaattctacaatgaacctgacagtgagtcagaagaagatgcttcatttcaataaaccaagaatatgcatttccatgacatagaaaccccagatgtaatggacttaaaaagatctgaatgtcctcaaaactgtgaactaaaaaacagttgagagaaaatgagatcatgttccaagctacaccagaaaaacatgtttctgtgaagtcaaagtaacaaggagaatgccggcaagcaaatggatccacttctccatccgtccctccctcgcaatagaaggaaaaacacttcaatatgcattctgaagataacagaagcaaaagcaatccaaggtctttattacccagctaattctttcagtaatccagtttgctttgtatatagaagcagccactatctgtaaataaaattgtaacttaagcctgatattcagccatatctcctgttatctctgacagtccaaaagtaacaaaaactagcattaattgagttcttactctggaccaggctgtgtgctaatggctttacaaatatcccctcatttaatactgaaaacatccatacgagacaggcaatacattgtgatattgccatgcaacaatgataaatgctagctctcattgttactattattgtcattataaccaggtatcaccttaatgaggaaaaacctgagacttacagaaggtctgcaacttgcccaaggtcacagagctgggaagtagtggagcccagattcaggctcagttctttgtggctagaaatactgccaagcatttaactgctttagtataagccagtagaccaaaaaatagaaaatcacattaaaggaaaccagtgcactattaagcagcaacagagactggaaacaagtttctgctcagacacaagcactggcattgtgagtagtaagaaactacaaactgtcttccttttttattgtatatatttaaggcaaacaacaggatgttttcatgtgtgtatgtgtgtggataaatatgtattatatataatgcagtaattactatagtcaaacaaattagcatatcaatcacttcacagttaccttcttttgtgttgtgtgtgtgtgataggagtacctacacctaacagctcaacaccaaggagagagttcattctcccctaattgaccctttcattaatcattatcgttacactacttcacatcaagctgcttgatgaccagatcagaaagagattcattgcttcattcaggaaatatgaatgtttccccaactacagaccacaacccaagatccttgcccgggatgcagaatgctctgacaagagggtaacgttccttctttgtgattatggctcatcataattacttggaataaaaataataaattttaattcagcaatgcctatggccattgggcatcttaacataaaagaatgaaaatataattaactaaatcaaggcaatatgcctatttccatcccagctcattagtattaattgattgggttaattctcttttgtgtttaacggtgcccctaaaaaatattttttttttaaaaaagggagggagggcaggaaggagggaagaagtagagatagtaagtagacaaaagttctggatctttttctaattaaaataaaataataaatgcagctgaagctcttatcacagtcacaaaagaatctgctactttttaagttgggagtcagtacatatagcatcataaataatgacacaaaacattggggccacttctcaattgccccccaaaaatttatgaccctgccttctactatataagtaatatgtgtaagaaaaaaatgtcaattctattttatagatgaaaatatgagtaaggcacagagagttcaagactcttgagggtccataaagtgttggttttcctgttgtacgagcccagttttctacatatcaggatgctggcttccatgaatggaaaaataatataaaggatgtaataccttcataaagtatttccaaatgtagttcttaggtgatctagtttcactgttacttagcagtaatcctttcaaaatatatatacttcatgtagaatgtattctttgtaatatagaaatggctgagaaagtacttccattataatacttcatattttgtcggttaaaatcttttgaagaaattatttttggcttgaaatttctcaggctttatctaagcctgcagatggtatcagaaaaagtaaagaaaatttcactcagctatttttctgacactgtgaatgtatatgaaaaagatagtaactaatatttggagggtgagttactgttgttgttgttgatgatgattgtgattattcaatcttatatttgaagagctctttattatctttcaagtactttcacacatattatagaccaagggaagacattaaaagaggtttacagctatgttacattgatcagatatttgaaagttgtagttcttcaccagtgaagactttggtcatatgccttttagaaacagaaatataacttaccaacagattttatattcctaacaattcatcataatatgcaaatatatatagacatatgtgtgtatgtacatattttgcgtgtgtaaatatgtatatgtgaatatgtaagtgtatatgtgtgtacttatacatacgtgtgtgtgtgtgtgtgtgtgtgtgtaatcagtgagaacaactaaggacagtgaaagtaaattagctgggaaaagtggtatttaagagagcaagggtttaaaatatacacttcttaaatttcacccaggaccatttacttgtccattctttctacaatcaacataaaatttttgagccttcgtcatgcatcaggcactgttctagaccctgaagagacaacagtaaataaattgatgaaatcctttgtcttttttgagcttattctagtagaggagacagactataaacaagcaagtaaattgataatataccatgtgatgataagtactatgaagaaaagtaaagcaacatcaaaggataaagagtcctggggggtggctgtaattttagaaatgatggccagcaagtcctcccagattagttgatattttctcaaagagcaaatgaaataggtgagccagccacatgaatgtggaagaagagcattccaggccatagacattacaggcaaaggtcctgaggcaggtatattcatagaagagctagagcagagtgaatgagaaagacaaggtcaacaaggggatcagaggttaaataatagtaaggaccagtgatttgattcccagtgagttgagattccactggaggttttgaggagagatttgacttaaatttttaaaggaaatggaccataaactgctgggggtttactttaccatatagcataaaagccaaatatccattacttaaacccatgaagccttattttcctgtcacaaaaagttatttcagaggtgggtggttgaatgccttatcatggcaactccagagtcatcagggtcctgggtttgtcctattcttccgcttttccattctaactaacaagtagcatcatggtccaaaatagtggccgaaaatgttgctattacatttatataccagcaagtaggaaagagaaagaaggaagggaaaatagggtgtagttcctactgggtcatctctacttttggaaatttctcagatgttctgcagggtacttcttctatctcatggtaagcccttagccacatggctatgtctagctacaaaagtgttcaggaaacagagcatttcagctgagtactttgttgccaccaatgaaattagggttttactactaatgaaaacaaggaatctgaaatatgggaacaaaataagaggcaatttaagatggtctaggccaaaaatgtggtggttaagactaggttagtaccaatgaagtgttgctacatgggacacatgttgaagatccagccgacggggttcactgatggggtggtcataggaggtgaaagaaagaagtcatggatgcctccatggtttttggtctgagccactggatgtatacaattccagtaagtgagatggagaatttcctcaaactttgatttgtgtatatgttaatatctatgtgatcgcaatatgtctcagacacaaatgatctgcccttcacctcctctccgctctccaactctaatcttacacaactgacaccaagattaccccagtatacattcggcctcactgccagcatcacttattttagaaccagaagttttagtcttttacatttactttctaattatttttctttggtaatattacatgttactgccagtattattcttcattttttcttgtatttcacacaggaatcctaggccactcaataagcattcacaaattatctgttgaacaaaatttgatctgtgtccttgccctgttctcattctttctagaagttatgacctatatctctatgataaaaacctcagcgtttcactctaggtagctctgtcttttgccaacaactcctgtatcttattcgtgcagaaactggaatctactacttagccttacatcctacctactcctcctccccaagagaaagaagagacccttcagatgacttactctccctctccacaggatgagggtttgcctttccaaacctaactcacttatctaaataatatgagagtgaaatattacctaaaccagaaatgctaagaaaaaccactattggaggttggggcaagtattgggattgctcagatatttaaatccttaagagtgagaagtcaaatgaatgttatacttatcctgcctttctcctacacttttctctccttctgatgcctcttctctgttttcagcctctggtgctgtcaacactattcatgatttacctggaagtaacagtacatccagagatttagtaatccaagactttcagctgggaaacttctcccaaatggtagtagcaatataaggccaagacctttgaatgcctgaaggggagcccatactcctgcagaatttgattcatatggagaaagccctggttaaaggcctgccaagagtatcttttctctgaaatgaggctttaggtctgtaattttcctttgtcattgctggtccttaggtagttgatgactgtctatagtggcattcccatagccactagctacacacacacacacacacacacacaaacacacacacacaaagacagggcaagagcccaagctgacagaccattttatcccctaaagggcactaattaactgatttgactgaaaacttctccttgctatagaagagaaaaaaaacagcttccagaatagagaatgacaaaatgcctaaatcctgattcggtctaaaagagacaggtattaaaattccattagtttatcctctttaaaatattttatttttcccctcatgtagctatattcttatcttaataaggatgaatgtttgtgtgttaaatatatttatagtaaagaacagtgttttagtgcagagtttcatagagatccataactaatcatatctcccatgtaattttcatttgccaatgaacagaggcattttgataactattccttatttccagccactaaagtaggccatgatttttattctcatttagcagataaggaaagaaatgcacaaagaggtgaaataactgacttagccatttgaagatgtggtagtagggttgaaattcgaaatctcagcctcttccaacttcataaaccctagagctatatagccggttttgcaataagaaagcctatttatatgactttccatgggaccaagaagtcaaaaccacaacagggtaaaagcaggaagacatggctttcttggcagggtatttcaaaggcagcaacgttaaccaatttcagggcattttgctatattgtgggggctgtcctggataagcatgactaaaaagtgcttgaataaagaagcatattctttgagaacactgttaaccttcttgtttttgaaaaattaaactaatcaagctctgtgcttataatgagtccaaagaaaggcctttcactttgaaccctctgaccacttcttcctttacatagtaaaatttcagtttggtctgaggataaattgtcaactaagttctggaacttatccagaaagtttccctcctccatcccccctacaagtgatataatcatatagaataatattaccaacctacaaacttcacacacctttaatgtgcagtaagttgaggatgcttgtgttagtgtccagcagaagcaattggccattctccactgtgacgttgtcgccatcttgtggcagcctttcaggaaaccagctgtgagtcctggaccatctccggcagaactgtaaagaaaagttgccctggaaaacagagagctgggttggtgggttggttggttggttggctggtctgttgcttcgttggttggttcgctggtttgttggtttgttggttcattcattgtttttgggcgggatagtataagtattgaatcaaaatagaaacttctcaaagaaagtaaaattaatttaaatattttaaatgtctccataaaattggttacctctctctttttcatacaactaacctaaacaggaaaaaacatgagaggcaaaattatatttgaagttcttctgtgcccagcccctggaattctccaataacatgctggtaatgttttcttgccttttttttcccctctagcacaggccccattctacctaacagatgagtttgattccatttatttttacagatatgtattgaatcttggacaaaaagtcataaatagcctggaatagggagaattaaaatgttctgcttgatgggtggcattttgctttatgtaattggtatcatttttcactggctctactgccaagagtccctgttttataggaacattcctcttcctaagtgctcagatctatcctcccactcggccttttttgatattattgttgcctttccccctgtgcctggtgcatcagggctgaacaaagcccatgcaggcataggcagaatgccgactgacttcagatgacaagtaaatagtctggaacatttgagtgaggggtagggagctgtactgacagaagaagccagaaaaggaagcactccctctccaccccagccttcagtccctctctcagaacttttggctttcctgttaatttgtggtcactctgatgtcatacgttttttaaaacagggacataaaaatcacagaaagcaatattgagctcatgcaagaggctggtaacatgtctaaatgccttgtgaagttgtagaagtataattacgataaacataataaaatcacaatagagaaggtgattccttcaaggtaatagatatgacatgtataagccactctctccagtcttcttcccattcagattccaacaaatgtgaagcccaagttcctataaaaataaaccacctagaaggtcctctcatgatgtgttagaggcagatgggagaagatcattagaagggaaggcatgtttgtaataccgacaactacacctacacagagaatagtgctctatagtatttctgagatagaaaatggaaaattgtgttgccagaagagccgttacgttttccagaaaaagatacaaaccccaaggtcaacagtgctaagttgcagacccaacacaatcactgagaaggctttgcaatttattcgttttctacatctgcaaagaagtaaaagtctatgactcatcacaatttaagagatggaaggaaataaggcatagtgataaccagttccagtatcacagaaaaaagaataggtgatccaggagcatcgttgtgaactgcagtatctgtaggctacaaaagtaggagagaattttaactctagatgatttcactataggactagctttaggttggtaaaataataaacagtacttcttataaggctatatatattatacattcttataaccctttaatttactcctgtagaatacagaaagaggaaagggaggcaaatcaaaggaaactggaatgaaagaaggtgggaaaaacagagatggtaaagtaaactgcagaacagggtgaaccaggttatctgtagtgtcagctgcgagtccatgataaaaggacatttgaaaactcttggatttccagaagcccagagatggaaaggactctagcaaaatcctatcccataattttacagatgctattttaggcagtgttccttagagcttaataaaatgtagatttctctagtgtcatcatatacctgtgaaatcaaaagctcaagaattgggacccagagacctacaattttaatgatcctctcagatgacacttctgcatcaaaatttaaggatcaattcagagcaagggctggaggagaaggagatatatctttaaaaggaaccaagatgttttctccaaaccaacatccaaagcttagggtctttggccaggatcgcccaaagactagcaagctaggaagaatgatgtgttgatgaactgtaagaaatatgaagacttcagcagcataacgctttctgagacattaacctggtggtcagatccataacccagccacagaactatgaagaaaaccagggctcattacacacacagtaaaatgatcgggaacaactagacattagttagatatttaagtgggtcaaaggtagactatttcatggtgttatccattaattaatttgagaacatttttaaatttttatgattagcacagatatctgttatctagctctcaataagctttagagactttcttgctctgaagcacttgcttatgccatttgctgccttccatgtgctataacctcttggcctagcctgtcagccttcaaagattgctatacttggtcccaacccagtaggtggaaaggtcaaatactgttatctctactttccagtggagaaagcaaaggctcaaagtgtttaaatgatgtgtcaaagttcatagtgatggaggcaaactggagtcacaaaaaggaagctcccatctgaagtttttcccttaccatggcctctcccgggatgctctttcccaaaagatctgcatggctcactcccttacttaattcatgcctctgctcaggtatcacctccttacctgtattattatttttaaaaagcacccccaatcattccttcattccttctcccctaataatgcctcattctagtattaaataatacaattccttgcatatttggttatcacttactaagcttactcaaatgaagcagagacttggtttgggtcattgctatattcccacctccctaaaagatgtctagcacatagtagttgctcaataaatgtttttgaataatttattaaatgaatcttatacctgctggtgccatacatgcttttacagatatcacacacaaacacacacacatctcttcctaatgcaataggtgaagatacaggtgctaagaccttaaaaatgctatatcccctaggtcttctgaaacatttacatcccttttcgtgttttcaagctccatttaaacataaaccaaatgatgaatagtgctacttaattggaacctgagactcagattcgatctcataaaatcttccaccaattttttctttcaccttaagtttctctagtcaatgtggccaatttcaaatgaatacagatgtttaagcattcagtttcaagagacctaagtttccttgtgccctgaattccccttagcataacaaagatatcttgagatgtataaatgtttattgatgtactcatgcttttacacaaaataattactaaatactaaaaaatctaaaaattactgcagcatccactgcttaccagctacctggggaaatagaagagcagcatatctctatgattgcaagttatcagtgtaatccatgattacatgcacgttgccataagaattttagctctcctacattttcagttaacagagctggtgctatcattccctcccagggaaatgctccatgaaacagtgaggatggctcaccttccaacatcttcatcctccaatccatgtcactttgatccaatcaagaaaaaaaaaatgccaacagcattgattaaagattttgtgaatatatttgagaatgtctctgttgataccaacatatttttggtgaaggccatgttccgtgtcaacagcccagcttacttccacctaatataagctctttcctctatagttcccatgatgctcagcctttagctttagtgttcttcctggagataaacacatcactcattcttattctgcagatgaagaaaatcaattcctcataggcatatgggggcagccgtgaaaatagagatacaagaattgcccagaacgtgacctcatctttgcatctagccccaaataaaccccaaaaaaagcagaaaaaaactttcctgcctcagctaggaagcttatgcaatttgttttcttcttacagcatgtcagcacttctctgaacttcagggaatgtgcagtgtctgcaaatcttacatgtcaccttaaatgtacttgcaacaccaccagagttatcttgaaagaagtcattgatcagcaagttggaacacccggcaaagcaaagacctatttgtgagtgtatgcattgagctggggtggcagaggaggtggcgtatgggaatctctgtaatcacagtgtctcctggctgacaagaacaagaaataactgttctgacacctcaccaaaatgtcttcttcctcagcatccaaatcctggaaataggaaaagacaagtccctgtaaccattttctccactccgtatccttctttattttctccaaagcactcatctctacctaatacaatgtatactggtttataatcagtcaacccctaatagaatgtaagcttcacaagagtgtcttgcttttctgctgtatccctagaacctacaataatgcctggcatctattggctaccccaaaaatatgtttgaatgaataaatggtcaactcttatttggacttatgatgccataatgaaaaatctttaataactgaaataatatgatatgaagctataatttaattttgttcagttcttctttacattgaaatgttttaatttttacgaaaccaactttatttaccttttttgtgacattcttcattatgttatagatgaaacatcctctttcaccctgacataaataacacttatatgtccttcttgattggtgggttttatatctgcatgttactcctcaactaacttacaatttatgttgatggaaagttttatacttttttcttgtttttattccttgctatttttcccccaaatagctaactgattgtcttcataccattcattaaataacatttattctcccaattaatactcttggctattttaacagttgaattataatgttcaatgacattaaaccttttggccaattaaaatcccaaatccttttgtatgagctaatataaaggcgtttctcccaaataaatgtgacctcatccttgttcttaaggtacttatattatcatttagaaaaatacaaatagccagataattaaagtgtgattgattcaataattaaaggcataaccaagatgctatgggagttcagaggattagatggctgaccacagtggagatggccttgcaggggaaatcaagtgcattaaacatcgttttctctttttaatctggacacaacagatgacacaggctgagattatttcagctgattataaaacaaaagatagtgtagaaaagtcaactatctacaaatccaggattatgaatagagcccctaacctataatctaataactctttagggaccaaaaaggaaattgaattagtttggtataatttattcttactgacctcatgcaggctctaagtgatcactttcttttctcggtggttataaacccctcatgattacaagataacatgagaatgtccttccacactgcactgtgtagcacattgactactcaaagaaatgtcaacagtactttttgtcagagattcctgcccagttcaaattgaccctttctcatcattagaaaaccaggcaattcattgtcttatctcttggttccacacacttcctatcctctgcgatttctcaaaggttgctgactctacctcagtgcttcatatatctaagttattagccctcttaagcttcagaggattttcaaagtctgcagacaggacaaatttacagtcttcttttatcgtttcctctatttgaatcttcaaatctcctctaatagtatctcttctgaattttaagtccaaagaccttttcacttgtgggagaaaaaatgataatgatagctactgattacttaatatttctaatgtcccaagcacaatgctatacattttacttacagtatcactaatccttatgtaaaccctgaatatctgagacaggtctcagttaatttagaaagtttattttgccaaggttgaggatgcatgcccatgacacagcctcagcaggtcctgatgacatgtgcccaaggtggttgggacacagcttggttttatacattttagggagacatgagacatcaatcaatatatgtaagatgtaccttggttccatccaggacaacttgaagcagggagggggacttccaggtcacaggtagatgagagacaaatgattacattcttttaagtttctgattagcttttacaaaggaggcaatcagatctgcatctatctctgtgagcaaagggataattttgactagaacggaaggcaggtttgccctaagcagttcccagcttgacttttccctttagcttagtgatttgggaggccccaagatttattttcctttcatactcacaactaaaaaatgtaggtattactctttccacttaaagtttaattaataataatggccaacacttacggggtgcacttaacaggtattatctcattttgttacagactcttttcagactactttccaggaactacagagtagatggatccctgccttcaacaaatgtttattgagcacccactacacaccaggcacaaaacaaattcctgacctcatggagcttatattttagggagataacaggttaaatatataaaactaatagtgtgctctgaagtaaaaaagaaacagggtgaagtggatcagaagtgccagggtaggaagagctatttgatatggagtgatcagagactgctctgattggattggattggattggattggattggattggattggattgggaaaggagcagagaagtagagtatgagccagaggctatcaaaggaggaccttgaaaaaagggtgtgcttggagtactgcagctgcagcctgaaggatcaggcggctggccctggaggaaggaacgctgtatagccagatggcctttctagtgatgcaatgagaaacactgcacaaagacctgggtagacatcaagttcttcatatgtcatagaaaaaaaaaatcaaggaaaacactcagtaacatataacgaggtcagcaaactacagtccacaacccactattttgatattggcacacggcatgacaattcatttacatattgtttgtggctgctttcagtttgtgacagaagcaacatggcccacaaagcctgaaatatttactatctggctctttataggaaaagtttggggaccccggtaaattctgtttcatactatactatcagtatagtacctataatatgctcagtatagtgtatctatagtacatcagtattaaaacatgcgcaaaatggaactttctgtaattgaaaataggtaattataatacagctacctgagacttgagggactgcaaacaaaaacatcttagtgaaggatatacattaaagtactggaaactgattcaattcttcccattttttagtacacaataagccagatctcagaaagccacagaaaggcaagtggaagtgtgggaagttgtgtgtgtgtgtgtatgtgtgtgtgtgtgtgtgtgtgtatgccactcacgcactcacgtgcatgcacatgaatacacacacacacacacacagagccagatcagaagattgacagatacatgctagcctttttcacaagctaacacactgccatttaaccagcgagcatggagcacgtgtttgtgttcccagtcactattaagagacaaggttaacattttaagtgatggactacaacatgttatttccccatgcaatggacccatgacggcactgccttcgaaaacacttaatttcggtgattgaatacacaggagcgtactttccctgctatgaacgtttgacagctccgcagtttcatacaccaggaaaccttttttttcctcctttgcttttttcctgtctttacacctgaagggaagcaaaatggatatgtggtggcagaggaaaaaggaagaagcccagagaatgaaaaccagcttatgagcttcagtgtattttaaaataaaagtattcactgccatctgctctaattacttctaatgtttgggctaccatcttcatacaatagaaataatgatctcctcaagggcaaaaaaaaatttttttacagaaacaaacaaaagttgattacatttagctcccaggctaaagaagcatcaagctactttgtagtgaacaatcaattaggagaatgggtaggcctccgattaacactaacaaattaggtccttttggtggttccctcccttttcttcttttcctgcctctttagaggagctgtgctcacagctcactgagggcaaagagctgactaggcatatttctggatctagggttattccacacaaattccttacattttgatcagaaccagataaggccaagtcttctccctgtcttcttgttgacatcagacatgtcccagctttaatactgaatatagggctgggtattctaccaagacttcggattacttcatggagtgaactgcttaggggccaccccagacttgaactcctctaaggaagctaaagcccacttagcctcagtaaagtctccaggaacagacatgatccaggccaggtccattccttagacttaagtgaaacacatggagcccagaaaaacatggaacagacttctacaatgccagcaggagaaacgttgctttcacaaaggctgagtctagtgaccttctcaaatcctcaaattcaaacatattacttgtatgaagcagaattctgagatgtcctaggattctgaacccctggtgtacacaccctgtgtagtcctctccccttcagcagaagtagagcctgtgaatatgatgggctatcactcccatgattaggttatgttatatggtaatgatgatagaattatgcagatataattaaagtgagagatcagctgactttgagttattcaaaagggagatggcctctacctaatcaggtgagtccttaagagagagattctcccactggccttgaaggagcaacctgccatgtggcttggaggagaccatgtggctagaacccaagaacagcctttaattgctgaaagtggtcacagccaacagccagcaagaaaatgaagacctaaatcctatattcacaatgaattgactttcactgacaacctgaatgaacttggaggtagaccttgaattccagatgagaatgtagccatgctgacactttgatttcagccttgagagaccttgagcagagaacccatctactctgtgcccagactttttaaaaaatttttttaatagatttagagggtacaagtgcagttttgttacatggatagattgcatagtggtaaagtccgggcttttagtgtaaccaacatctgaagagtgaacattgtgcccattaagtaatttcttgtcccaccttctttccaccctcccacccttctaagcctccagtgtctattattccactatatccatgtgtacacattatttagctcccacttataagtgagaacatatggaatttgactttctgagttacttcacttaagataatggttccatacaggttactgcaaaagccatgatttcactcttttttattgctgagtagaattccaatgtatgtgtgtatatatatgtgtacacacacacacacacatatatatataaatacatacacaccatattttctttatccaatcatttgtcattggaaacttaggttgattccatatctttgctattgtgaacagggttgagataatcacctgaatgaaggtatctttttgatataataatttcttttcctttgggtagatacccagtagtgggattgctagatcaaatggtacttctatttttagttctttgagaaatcaccatactgttttccataatggttctactaatttacattcccaccaacagtgtataaatgctcccctttctcagcatcctcaccaatatctgctgtagtttgactttttaataagagccattctgactaatataactcggtatcccactgtggttttaattttcatttctctgatgattactaatgttgagcattttttcacatgcttatctgccatttctgtgtcttcctctaaaaatgtctgtttgtgtcctttgcctactttttaatagggttgttctggtgttttgtttgtttgtttttattgagttgtttgagctccttgcagatactggatattagtcctttgttgtatctgtagtttgcaaatattttctactgttctgcaggttatctgttcattatgttgattacttattttgctgtgcagaaggtttttagttttactaggtcccacttgcttatttttggttttgttgcatttgtttttgaggtcttggtcataaatactttgcctaggccaatatccaaaaaagtttttcctaggttttcttctaggacttttatactgtcgggtgttacatttaagtcttcaatccatcttgagttaatttttgtataaggttaaagatagaggtccagtttcatgtgcctgcatatggcagtccaatttcccccgcacacttatcgagtagggtgacttttccccactgtatgtttttgttggctttgtcaaagattagttggttgtagacatgtgactttatttctgggttgtccattatattctattgatctatgtgtctattttaataccagtaccatgctgttttggtgaccatagccttgcagtataattcgaagtcaggtattatgatacctccagctttgttctttttgcttaggattgctttggctagttgggcagttttttggtcccatatgaattttaggatggttcttctaactctgcaaaaaatgatgttgacattttgatagtaattccatagaatctgtagattgctttcaatccgtgagcatgagatgttttttccatttgtttgtgtcatccacaatttctttcatcaatgttttgtagttttccttgcagagatctttcacctccttggttaaatatattcgtaagtattttatttggttttgcatgtgcccagacttctgatctacgggaccatagataataaatcggcattgttttaggccactaagatggtggtcatttgttatgcagcaacagaaaattaatatgccactataaggaccttcttgagagaacagttttcacagagaccatgtttagatttttccctctttattaaagttactgctcaaaagcataaataacagcaagaaaggtgggatgccagtgccaggcagaaggacaggttattcgctcactgcataaactctcctcacacaggacatgcaacatggaatttttcaatttatgatgccaaaaaatgtaaagtaagacctgatgcagacctttcttttgctcaggaagaattatgactaccaaagatatacagtaaataccacaaggacttctatgtagtcaccaatacttactatctaggctgaagaaatgaaaactttctgatcctgaacatggccaggatatgtgtgcttagggggataacgaagttttttgtttgttttttgggttggttttttttgctttttgttttgttttgttttgttttgttttgttttgttttttgagacagggttttactctgcacccaggctggaatgaagtggtgcagtctcaaatcactgcagactcgacctcctgggatcaagcaatcctcccaccccagcctcctgagtagctgggactacaggcatgcaccaccacacccagctaatttttgtatatttctgtagagacaaggttttgccatgtttccctggctggtcccaagctcctgagctcaagcaatccgtccagctcggcctcccaaagtgctgggattacaggtgtgagccaaccacacccaggccaacatgaagaatttttaaaggcccgtattctgactctatgtctgagaatgatatttgactatgattggtattaaaaattctactcttccactagcattgcttcctgagaaaagaggattttcttttttttatttctcattttaaaaaaagaaagataaggcaacaagtttcagggaaaaaccaagctcaggaacaagaaaaactcattctgtacctatatcttcactagccttgactaaataactttttcctagttctttaagcttcacgtttgaggtactttttagagagaaaaagaaattcatttgtttatcctcaaagcagcatcatgtgttcttaagctttctgcatgtattgcctggtatttgataatgtgcaaggttatttgtgttaatgctaataccacaaaattatcaattgtacctgaagaatgaggaaacccaggaagatgtttcagaggtggggatgaaatctcaataacctagaatttgagaaacttgcctatgcaatctgatgcagatgctttccttgtacgtgcagattttgtagaataaaaccatcaccctcatctttgtgaacatttactgggtgctcactctgagccaggaactgtgggacctagccttgtctgcatgaaggcataattgaatttctaagctcttagagcccagtttcaaatgcattgttccctttagcccaaacacatccgccacacattgtcccttttctgccaaaccctgtttattggttccaaatgcaatgaatcatttactgacttgagcaacattagaggtaaacaccaaggttaaaacgtagagataattgaataacacaccaactaccagtaacagcagtccaggcaaaagaggaaatagatccagagatttcagaaagggcaatctgataggaaccctccatgtcaggatcaaaaccgcatgccactttgacatgacagaaaaaacatctgcattttatttttttcaaaattgtatgtgccagttattaatatgggaagaagcagaaagcaagcaggtggtaacataacttaaataccccagtgattaaaaataaaccatccaaaaatcaactatcatgtatttagtataccaaaacagtggtgtaaagctgggttttttaaaaaatatatgtgtctgatttattgctttcactgttgatgaagaagattaataaaatatatgcatttcttttgcagtacacttttctctggagaaaactccagaaagcaaacattgtccaaagcccttccaaaaaatcataaagctcaatataacttccatatagcaaaatgcactttaatcatttactttacagtcacctggaattcattgtatgcaattcacataatgtctaaacttgggcatataacatatacacatacgtttataccaaatttcctttttacgtgtcctcaaaggcagaaaactcagaatctttggtgaatactaagcaatccacaggcacagttttttcccaggaagtccctcatagtttggaaatccaaaatccccaaagaccctcatgaaacaagacttcaagtgcaatagttaactaccttgggattcaaggctgaatttactcaataaaccatactaaaggtttatcaaagaccacaacacctctcagaaacatgtgcaaaatacattttccagaattctcccaactttggggaattacacccttgccaaaaatgaattgttcaacttgctgaggattaattatttatgtggctctgttttgctttaagaaaatagagatttcttttttccccgttttcccaactagaagaaatatagctcccaagaagcctctgtgttatagttcagggataatgaaagcttagctattggttccaatatctcattttataaatgtgaaactcagtgactgatacaagattacccaatgaattgaataggggtaggtcaggacaaacaccaaatcaaagtgatttttggtcttttaaaattttcttgatagagcaatcactattcatcccagtacgggtgaatcacatcacagaccccatgaaaaagggggcaagcaagaagcacagttttctattattctaccatttcccactcattgatgaccttctgatagccccctctccagaagaagtttcccttacctgggatgtacctaaagtagtgtttgtttgtttgtttgcttgttttagaaaattgagaaagaaagaaaaaaaaacattttttaatcaatcaccatgaaccagaaagaattaacttaccttcttactcccttcttatactcagcctctctcaagtctttaagcttctcatctgggcaaaccaaagcaaacttaaaccatgcttagtttaaataattattttaaaccttttgaacagtttgagaatatttaatgacaatgtaataggcatagactgttgaaagcttgtcctgttccctaagcaaccaggatgataagaagacacccaaagtatgtttagaggataggaggtcaatgtagaaaataaatgaagcttaacctggatggagttggagaccattattctaagtgaagtaactcaggaatgaaaaaccaaacattgtatgttctcactcatatgtaggagctaagctgtgaggactcaaaggcataagaacgacacaatggactttgaggacttggggaaaagggtgggagggagtgagggataaaagactatacacattgggtacagtgcacactgtttgagtgatgggtgcaccaaaatctcagaaatcaccactaaataatttattcatgtaaccaaacaccacctgtttcccaaaaatctattgaaataaaaaataaaaataatagaaagaaaaggagattaggacacagatacagaagaaagaccatgtgaagacacaaagagaggcagtcatcagcaagccaaggagagaggttcagaagaaatcaaccttactaacaccttgatgttagatttctagcctccagaatagtgagaaaataaatttctattatttaaacaacagaaaactaaataaataaaatttaaaaataaaacataaaaaataaaattaatgaagcttcattacattttgcatattaagcaagaaaattgaattttaaagatagaacttaggctaatttataattcacataaaagacgtttctttgtttttacttaggagaaatattaatgatattgtatttgacaatgatttcttggatatgacaccaaaagcagtacaaaaaataaataaataaattggacttcatcaaaattaaactcttttgtgtatcaaaggaaatcatcaatagagggaaaaagcaacccagggaattggagaaaatatttgcaaattatacaactgataagagattaatatccagaatatacaaagaacttccatagctcaacaacaaccataacaacaaaacctgatttttaaagtgggcaaaggacttgaatggacatttttccaaagaagatatacggatggccaataagcacatgaagatgttcaacatcactaattatgaggaaatgtacctcaaaaccacaagataatactttacatccattaggacagctatcagccataaaaaaaaaaaaaaacaaaaagaaaaagaaagtgaagtgcagtgttgcctatagtcccagctactcaggaggctggggcaggaggattgcttgaatctaggagttctgagctgtagtactgcactatgcactaagcatgtctgcactaagttcagcatctatatgggacctctccagagcaggagaccactccattgccaaaggagggatgaatcgacccaggttggaaaaagagcaggtcacaactcctgtgctgattacgagagtagctggagcctgcccatgaatagccacagcactccagccgggataacatagcgagaccctttctctaattaaaaaaaaaaaaaaaaaaaaaaaaaaacagaaaacaactgttgccaagactgttgagaaattagaaattagaactcttgtgtattgctggtagaaatgtaaaatggtgcaatcacaggggaaaacagtaggacaattcctcaaaaaattacatagattataattcagcaattctgagtatatgctcaaaagaattgaaagcagggtctcaaagagacatgtgcacagctatgttcgtagcagcattatttacaatagccaaaaggtggaagcaactcatgtgcattgacagaggagtggacacacaaaatgtgatatatacattcaatgaaattttattcagccttaaaaagaaaggaaattctgacaaatgacacagcatggataaatcttaaggacaatattatgctaaaagaaataaaccaaacacaaaagaacagatattgtataattccacttgtataaagtgcctattagtcaaatacacaggaacagaaattagagtggtagttgccaggtgctgggggaaggaggactagggagtcattgtttaacagattccagtttgggaagacgaaaacatccttgagacggatgctcgtgacggttacgcaacaatctagatgtactaaatgtacacttaaaattagttaaaatggtaaattttatgttgcgcatattttaccacaattttgaaaactgaaaggccaggcacggtggctcacgcctgtaatcctagtactttgggaagccaaggtgggtggatcacaaggccaagggatcgagaccatcctggacaacatggtgaaaccccgtttctactaaaaatacaaaaattagctgagtgtggtggcacatgcctgtagtcccagctactcgggagactgaggcaggggaatcacttgaacccgggaggcggaggttgcagtgagccgagattgcaccactgcactccagcctgggtgatagagtgagactccataaaaaaaaaaaaaaaaaaaacctgaaaaaagatgtttctccatatttgataaaatcaatattcttgggttctgtaattctatagatcaaaccctcagattaaaaaattaaacttacttagtttgttcagtgcttctctgtaaagcctatttggaattggggaattttagaacatctaacatcctcatttttcagatgagaacactgaagcccagagaggtaaagtgtctttctcaaggtcctaaacccaggtgaaagaatgagaaaacagaaaagaaggcaaccctcagtatatatgcttccctcattgctctgtgaagggtgggtttgcacaccttgtttctgtgtgtgtgcatgtgtgtattcacaagccctgtttacctgtccacgctactcccctactcccaacctgaaaacttacagaaatcacctgtagtcttcagatacactctgctatttcatgtcccatgccttcatttacagagcttgcctccattagcttcatcgagaacagcctttcacccctgttctaccagacaaactcattctttcaaagccaggtcattcctctttcttccagaagcttttgatattgtcccctcaccccaaagcagagctaccctcacccttcttactgcttccaccaggctttgcacatactgctgtagtccttaccccacactgccttacgaagtttagtatattgtagtattttctatttccactctctaagccagctccactacctaagccagatgagtggagctgcaagagaacctatgggagagcttaatggaaaaggcactagtatttgattcccacctggaaagtctaaagacaagagactggctggagctgcccttgcccagtggcagagggaagagggggcactggtttgggggcaagctacatgtcacctctggagagacaggcaaatgtagatcccaccaaagggaacaagctgatatgacttaaagagatctttcccaagaggcagactggattggtgagggagaagcaaagctcctcaccaccatcctccccgcaaaaaaatgggccagccattcagagagagttgcagacctaagatcccagcaggaggatctataatgaagccacagaaaatcccataagagagagctgcacctgccacacatgatgtctcctttggccctactcatctctcctctcaggccaactcctagaggaaggaaggaaggagatggagagaagagagaaacagccattccccaccccaccccacaccaaggtttccaagccatctaggggtgaaggagccttttaaaattagataaatttgggggtttcaaaattatattggactgaattggagttaagagattattagagcccatcaagattaatgtgttcaaaacacatcataagataaggacttcaaagtagtctttgaagactacctcagccaggggcatttcagtgttcaagggctgtcaaagccaaggaacttgcaggggatggactagaggtgaggaacaggaaacacccaatgtcactaggctttcaacaaacatgggctgtgagggaagaagaaactcagttacatgctaaaaggggccataaagtcaacagaggattaggggaagtttggggttctttatttaagattaaacagtttatgaactgagagaaatgcagaaaagagatgaggccgttttgacatcaggtgctaccaagcaggagaggaggtaatctagaatacaagtagggatcagcccccttctctgctcatctcacaaacactgtaagtcccaggcatacgtcctcttcttcctcatctgcacattcttcctggatcctgtcacctcctgtggcttctattatcacctacctcataacaattttcaaatctgtatctcaaactctgaaccgaaaggtttgaactgaaggagaaagtgtctcaactctctcctaaactctaaatggatggatatctccatttgtatgttaactggagcactcagccataacatgtgtataatgacattcattattttcccctttctacaaacttatttacttagccattaatatcaagtttacagagttaccaaacaccaaaaatagaatcacctgacttgtcccgtccttaatccccagcgtccaataggtaaccaagttgtgtccatgacctcataaatgcctcttcattcattcttttcttctctatgtatgcagttacatagagaagaaaagaccatacagaacatacagagtgtgtctgaagactacaggtgatttctgtacatcctcatgtaggccttagtttaagagctgctcatctctcaccaggatcttcttgactgtaggctccatgagaacagacagcatgtctgtttatgcatctagggtttattgcagcacttggtacatggtaggtttttaataaatatttattaaatgaatgaataaatgttaaatggacgaccattgattgcaacagccattctgatctctctgcttccaatccccccacatcctttcattctcctctgcattgctaatattctcttcctaggaaaattaacctcactcattcattctctctctgtctttctccctctctctctcctcctcctctccccccaacacatagtcacccacacatacagtcacccacctgacctgcctcccacacacacttagaatacacagagtgtagagcttagaaaagagctgactccagtgcctagagaacaaagtccaaattcaaataagtatctaatcctctaccctacaagtggtctcccagcctcatccctcgcttctccccataattctgctggatcatgtgccatcctcaagctataccaaaagccacagtgtcccctaacataccctgacttgtatgcacgtgttttttctctcctgagcagtccagttgttttccaaggactgtctccatttaaaatctctccagaatgatcttcttggaccctggagaagctatcttctctcagtgctgccctgcgctcagtgcccactgcttttgtgctccatatttacatcaatgtttcaccttgctagagtgtgagttttaaggacaaggactatatggtagtcacatgtatattacaagtcactagcacctctcctggtacataatgagcacttgccaaattaattagaccaaattcatgaattagacccatttattacccgtatgtaacaagcaacaaacaaatgggggatgtcagtgacaccaaaatgctttctcttgcctgaaagtttataatttctttgcactctgttaaaactatttcgtggtttttttcaaatattatagaaaatattcatcaaggtataactcaaactcctgccaccatgtctgccagcagaatgtcagtagacctgcttcaataaattgatagcacttatttataatttgcagcccccatttgcatgcaaataatgtgctacagttcataaagttgatttttctcttaagttaaatattctacctacaatgttgttcatgtatcaattaatgaagttttactatattcaacccataaacatttattgagccaggtactgtgctagacccttaggataaaatgacaaataacataattccctgctctcaagaagctcactgttgaaaaaaaccaacacacaagccaagcattacaatgagacaggcttgtttcttttcttacaagggcaaaatgtggacgtttacaagagaaggtagagaaaatgaaagctaaaaggtagcagttgtaggaatacttatcagactatgatcttacttgcagaaatatctcattacttggcttttaaaagcaatcatgcaaacttttgatactctgaacagtacagactactcaacatgatccctattataaccctttatctgtgagccaaatatcattgaaatctatgaacaataacaatacagtccacttgaagaaagtaactagattcctttaaatatcaagatggtagaatgtttacaattaacagcctttagtagcatagcaatatttgtccaaatcagtcagctttttaaaatgtctaaataaactgttggaggaaaaaataaaaagttaagttcctatattttggtcaaaaatgggaaaaagctacagcgtttataacctatttggaacacatgcctgcctctaaaaaggaatcactataaaccctcacaagaaacctctgacacaagatcccctgataaacactcaacctgcatgctcttcccactacactctacctctactccgattgcacagagtcttgcaaaaacctctgtgcaacccaagctcaaattcttcaaaggcactgcggtacagagcccttttagagaggctccaaagctcaagctctccctctccctctccctctccctctccctctccctctccctctccctctccctctccctccacggtctccctctgatgccgagccaaggctggacggtgctgctgccatctcggctcactgcagcctccctgcctgattctcctgcctcagcctgctacgcctcactggttttcgttttttttttggtggagacggggttttgctgtgttggccgggctggtctccagctcctagccgcgagtgatccgccagcctcggcctcccggggtgccgggattgcggacggagtctcgttcactcagtgctcagtgggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggctgccatcccatctaggaagcgaggagcgcctcttccccgctgccttcccatctaggaagtgaggagcgtctctgcccggccgcccatcgtctgagatgtggggagcacctctgccccgccgccctgtctgggatgtgaggagcgcctctgctggccgcaaccccgtctgggaggtgaggagcgtctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggaggtgggggggtcagccccccgcccggccagccgccccatccgggaggtgaggggcgcttctgcccagccgcccctactgggaagtgaggagcccctctgcccggccacgaccccgtctgggaggtgtgcccagcggctcactggggatgggccatgatgacaatggcggttttgtggaatagaaaggcgggaagggtggggaaaaaattgagaaatcagatggttgccgggtttgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgtcaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaataataataataaataaaaaataaaaaaataaaaaaataaaaataaaataaaataaaataaaataaaataaaataaaaaaaagagaggctccaaagtatccacatcttaaccacatcggacgcctttgcccagcctccctgaggctcccacaacacattctgaaatctcagacattgcttaagcagggcccaggaagcctttgcaagacaaaggaaggaaacacagtgaagtgtaccgttaacaaaacccaaaatcaaaaggaagtccaagtcgttgtcaaatttgtaattggtagctccattattaattaatttgtcagagaatttaacacagcaggactatccacagtcataactgcacaagtaaattgagactaggttaaacaaaatttttttaaatttaattttctacgtacctacagaggtgagaactgcctagactacaaaaaataagggggcttgcttgtattgatattttaatctgaaacatcattattgtgtaaacggaatctccttttacattagttttcagagacaagactggaaacagcatatgagcacataatcatatcacagtgtgtttctctctcaaaagccgaaccttctgccttaacactttcacagactcctccaggcctgcttcaaacagacaaaacactcctcctaaaactcaaagaaacatcgcaacacctttgtaataggcctatttcccaagagggggcagataaaaggacaaagcaaattaagggaaatgcggaatataaacttgaaacctactgtcaataaaacccaaaacaaactcgaagcggaggtgaagaaagcagggggaggaaaagcaatgttaaatggtcatctttcttctcattttatttgaggaagttaagtttgcacagctccttacaagctgtctttggctaaaatcactattaatgagctttgacgtttgaaatttaactgagcacaagctaacagcttccagcactgcaccacccatgaagtcaactggaaatattttgctagggcctaacggtgtgtttattgaaaaggcacagctttcaagagaaagtgtttatagcaaccactttacctgctatccctgctctgtgatgtctgtttggttttagggtttggggggtcctctttaactctttctagtcacactgttctaattgttttcaagtctagcaggagaatgttaatgaagttctttgctctacagcaacctggattataaggacagatttgaaaactctgagttatgacaaaggggcaggccacaaggcaaaaagaaaaaagcccatagagaggcttcagctctagcattcgctcattagaaagacaagataaaaacacgtattctttatgggtaatgccattaaaattatcctttcccaaaagagaacacagtgactagatcaataaacctgaaagattgcatggattcttcttagctaaaatcctggttcattgaatgaaagtgaattcattattaaccaagtagtttccccaagagaaaggcatggaaggaagctattcactttactcctcaacaaagaaggctttaggcattctgacttgtttaagaagtaaaatgaaaaagagggattgagtctgaaagaaaagcatactcacacataccctgctcttgcacaaaatttacatgttgtcagtttctacctctaaaatttattaaaacaaagagggagcattattttgaatctcatgccacagtcctaagaacaatggtctgtgttcagtgatcctgtacagattcttgaccttgaacacacctggatgccaatatcagtatgaaattcagaactgctcccctttccctgaagccagtgttacactggagaatgtaggagtatcctttgcctgaggcattcctggaccaagtaaaagtaaaagcagaaattataacctaatctggaatgcctctaaggaatggagaggaaatctcagttacaaagaaaaggaagttcagaatctgcgaactagaaataacataatttcaaggtttttattcaccaaattaacgttgggttacccctacaataccaaggagaaaacgtccaaggatggtgctaaatcaatgaagacaattcagacattacaactagagaaaaaataaggagaaagcaagaaagttggattctttgtccaaagatatttttgtcattactagatatttttccatagaaaaaaaaaacaattactagatcatcaattattttaaaattaaaatgaaatcttcatatgttccttttttaatggaaatgtgtaaactggtacaactatattattttgcaatatgcatgatctgtgaaaaaaattagaaaaaaactacatacaattgaaggctatctctgagtttcatatactttctcaaaatatgtggaaagataaatgtggaagatgtctgttgcagtattgtttgtagaaatcaacttcttgaaatatttattgcaaaacaattaacacatgtttattgattctttattttggcctactttgtaagaaaaatccaatagtgaataaacaatagtttctgggtttatggaacattgtttaagaaatatacaacaacgaaaaatttaagaggaatgaatgttataaaaaagaaagcaggccgagcgcggtggctcatgcctgtaatcccagcactttagaaggctgaggcgggcggatcacttgaggccaggagttcgagacccacctggccaacgtggcaaaaccctgtctgtactaaaaatgcaaaaattagccaggcatggtggcagatgcctgtaatcccagctactcgggaggctgaggcaggagaatcgcttgaacccaggaggtggaggttgcagtgagccgagatcgtggcactgcactccagcctgggcaacagagtgagaatccatctcaaaaaaataataataataaagcatatgctaccctaaatgataagacacagggatatcttttaaaatagaaaggtttcttttttactgatacataataattatacatatttaagggatacatgtgatattttgatactacattctcacatgctatatgagttatttatttctagaagttatacaatggaaagtaatttttaaaataatttatgtaaccatttgtgaataagaatatatttgtgatagttattaattcacaaatggtaccggtcatattaacaacttatttataatcagcatatttccagttagcaaagtgagaatgtaaggtaaaaacgtaatgggattaataggaataattttgctatggggatctgtgtagttataatgatttcaagttaaaaaaacagaaatgtaagtaatatatagcatttgtctctaatattatagaaatgccatattcagacctgtcgtggagagggacatagctgttctcttcacaatctcagtcatgaatatgactaatgagaaatgaaggggagaggtggggaatttatcacaatatccacacaccaaacctcatgtacttcttcaagatgtgtctttcaagactgcactcagaatcgtatatatctattaaaattttgttatcttgtcagttgctgaagaaaacaaaaggatcaattagaaggaagtaggggctactgacagcatccagatgtgagacttgcagtctgacagcaaaggaagggacgaaatacatcaatacagtcatgggccatttagcaatttcaatagcaccacctgggatagagttattatttttttaaaaagtgaaacaactgaagtttgtgctgatgatccagaggtatcaacaaaatatttgatactaccacctatgttcaagtaaaaggacagaaaagccttcgcaatgttttagaagttaatatcaaaaataaacatggcttggtattttgacggaaatgtttcagttgcctagcaaattaactcctgtggtatttctcattccccaagcaaaatagaaaagtgagatattaggaaactttaaaactggaaaaatatatgacaccgccaggagttttgtccagaaatgaaatttggaaatggcctttatccaacaaatagcgtggcagcatttgctaaaccccaggcacagcagtaggtgctcagactacctctggcacacacataatctagcaggaaacaagtataatagccgatactaggtagagcacataaatagcatggctttaaagaaagcgtgggtacagacgtgtagaaatgctaggtgtggttgattaatgccgattgtgactactattaggtacacaggatatgaggacatcaagatagaacaccaaccagcaaggctgagagagccctccagggttgagggcacagcagaatctcagagtccagttgttttctcactcacttcaatacccccattttggtagcacattaaataaattgatctggatttggaaaatagcaaactgaaaaccagaacaacaattaaaatattcaaagctgaaggtatgaggctgggagaaatgataataataacaagaataataatgataaacactgaatgagcatttattagatgtaggacactgcataaaaaccttcacttctataccctgtttgaacttcacaatgaccttccaagagtctaccttattagccctatttatgatgagaaaactgagaaatgcagagggaaagtaacatgaccaaaaacaaaacgctggaaagtggtggaaccaaggctttgagaatctgttttcagactttagcagcccatgcccttaagcaatattaaaaacttgtctcaaaaataataaaagtttcataaatctgaaatgatgaggaaaatatagcctcagaaacagaaaggttaaatcagactgaatctccagtcaaaaggtgagcccaatcagttttgtcctctcacaggaaagaagttctttttctaagaccttttttttttttttctgaaactgaaactgtgaacttttggtattctctgattctccagaagaccctcaagtccctaagccctagcaattgttttattttactagttgaataaaatgggctctggaggcagtaacacaaattcaaatcctaactctaccacatagtcactctgtgacctttggtagtcacctaatttccctgaagctcaatctcttatcttaaaatggagattttttgagggctcttaatgagttaattagtatacataaaggctaactcagtgcctgacatataacaggtgtttggtaagtatcattgttcacttcttgcctttctcaacttttccttaaactaaaacaaggaaaagatagatttcttaagatttagttgttgcatcaccatttatggaaaaacaaagagaaatgaaaacaaaatcaactttccttggtgatgaaaacgccctatgtcttcaatttgattctgggcttcacagtatatacatatattaataagctatacacttaagatctgtacatttcattataggtaatttatgcctcaatatataagacaaattcttgacaaaataaatttttattttaaatataatatctcaaacataataattaattctattggcaaaccaaattatccagcatatattttatgtcgccaattagaaacttaaaagtacaaaaaacacatactacatatttttcatctagccctaatatttcattcccccaccttgctcccactttaaacaatcctaaggaaatttccaacagccactgttttatttctgtactctgcaagtagcacgttccagttttctatgcgagccttttggccacattacagccaactaccaccaccatatgccactggagtccacattgataaaagatctaagagttgaatggcactttcatacttagagagggctttacacctgtagatccatttaaaactcaaaaaccttgcaggaagatatggttaagcactatcaccatcattgaggggaaatgatggctctgagaaattaagtcaaggacccaggaccttggcgttgttagggactaggacccaagtcttccagcatcaagactcacagcttttccattactcttatacctttgacagaggaagagatgacaagacaagtcctccaacttgtgccaactaacgatgagcctgcacagcactagctatagaaaatcaacaacataaggccaggggctcacattgttaaagtctgtggctttagaaaaggatgaaatctgcctaaaaaatatttctctactcttcccagagttgcttttggaagcgatatctttatatccaatacgatccttctcaaaggtgagtattcatgctgcgaatccactccagtctccagggcctttgccctggtactgacattttaccttctacaaaaacttcatgagagaaaggaaaaaaaacaaaaactagatttttccaggtcaaataaaaagaaaaaacttatactaattaaagccatactcttttagacaaaaacactatttcagttctcccttctttgctttttctgctgcaaaacatgtttcaaggctaaaaaggagccaattaaagtttctattatcatgaaatacaattctgttggtgcagtgatactgagcaaaagcaattttattcctgcctttccaaaaatacgtataggtacatgtgaaaacaactatgcatgcaggcacacctgcaggggtgtctctatgtgcacgtgtatgtgtgtagaaaggaagaccagagagttatcacagaattgaacctgcacaattcaccacaaataaattaataatggcatattatgaagatatattttcccattatctagaggaactttgttttgcctgtttttgttattatttttcactcgagtcatcattatcctacagagaggaaggctaacaaaggcctttgatttcaccacttctagagatttaaacaaaagacttaacaatcccaattagaccattaaaatacctcaagagaaaaacaaagaatatacagctatatctgctgaactcccagtaataactcaaggtctgtcttaattttttttaaaccagaggaaatgaagggatagggggagggaggaaacaagggagaaaaggaaggaaggaaggagggaggaaggaaggaaggaaggaaggaaggaaggaaagaaggaaggaagaaaggaaggaaagaaggaaggaaggaaggaaggaagggagagatacagcaatttcactattccacccatgcacctagcagctgcgtttattgttatttatttatttcctcccttttgagctagatcctttttttctcatttagtccaacagagattgtcctcctggtgtgaccttttattcttcccttttccttcacccctccaggctattgccctcatgccagtaactagataacacactctatcaaagatttttttaaaaaatcattgggaaggcactagggctgatagtggcatcaatcgtagcctgacacgagctggggtcaaccatttatctctttacatagcctgtggttactgcagtggccatcttgacttgctacatcttaacaaccttgtgcagatgttgcctctcccaacactgataatatctgctcccccagtccttttgctttccttgtttggcatatttctttgttttattctggtggacatcttttcataataaatcagggcaagaataagtgaagcccctcccgtgtttcagagcccttccatatttcagggcaagggagataattatgggctatacaaagaatcttgctctttgtaccaatattttcaaactaaaatcaaaacacttttgttccttagtaaatagtcatatccttgaagttaaagtgaattcatgtagcattgctcttatttcactggatatgagattttatcaaaagttttttatgaactcatttattttccattctatcccactcttttcccatctctctctctctctctacccccaaaataccattcactagcttttttttttgtaacttattcagcaggcagcatcatgattaagagaaagttgaaagttaggcagactacatttcaaactcatagctccaacattattagccacagggcctagggcaagtctcctaacattttgaagcatccgtttccttatctgcaaaatggagctaatactatctactcagagtgctatgaaaataagtagaaaaaatacttaaatgccatgtgtctgtcacatataaatgttcaatgtatttgagttgccacttactgtcttaaagttaatgaagagttagttgctcagacaatggaatctggtgccaagcatcatggacaaccctatatacaaaactcatctttactgccactttttctaccactgtaacttcacttatttgggtctccaagaaatctgtttaaaaatggaaatacacttgggaagttttagaccttataaacataaactttaaataagactggaatggaagatagaaacaaaagaaagagaaaataaaagagactcaaaggaaaacttggtttatgtgtattgtgctctaatttttaatacaaaccctagatgcctcacgccttctagaaattcaaataaatgtaaaatatagccactatgagagatacccaagttaaaactcaccttcacccttaaaattcccattagcagattcttcttttcaaaggataacctacataacatagtcctcacttaaaaaaataaaagtaaataagctgatagctgttgaaggtagacaatgggtacacagggctcattatgctattctctctattgtcacatatttaaaattgattattttaaaagttaaataaaataggccccaataaatacattgccttaaataggctaattgtgatgtatttccagttgtgccaaagcccagtaaagaatagggtcaatatcccctgatgctgaaagggattgtttcttaagacttcacagagaaatcttaaattgtactttaatgatggactttatggataaatatatagtcatagaaataaatatatcactccaagcattgccaatgttaatcttatgaccattccagatttattcactcaacatacagatagcatttttaaattatttcatcatattcctatacttctacacccaatgcctgtagatactgaaattaggagttactatctctaaactctccagcttgaagattatggggcaagagtgccaaagagcacaggctctggaatcattatgtctcaatttgagtccctgctctgccactttccagctgtgggtcctgagacaagcttctaagcatttctgaatggttatcaacctgtaaaattgagatgataatagtcatcactttaaagtttcattctgaggattaaatgggcagttcaagtaaagggtttcacacagttcctgacaagaagcaagcattcaattaatgttaccccttcccattattattagtagtagtagtagttctttacaataaaatacagaaatatgcttctctaggtggcatcatagcaagtattgaataccctaatatgtttttctttccatttttctcaatcttcccaaaacagcgattacatacttggttgtttcattttaatgtttgaaaagtatcaatttatccaagtgaagttatgaattctgtgagcagaagagatgaggcaaagaaatcaagaatcactccctgattcagtggtgcctggatttgaaagggtgcagtatgaagatgagtttaaacgctggcatggctctcccaatttccacacaatttccttgtggagaagccaccagtacagggaaattttagaacaattttaccaagagaaaagaacccagacccctgctttcttagtctcccctcaggcgtgggcactgaaggcttcaatgagaggctggaagactctaactgtggcccaaatttcatgccacatggcagagcaaggcttttttccaggagcagtgcattgttaacttatcagacacattaataaattcctatctcaaatgtgcagaaaactcacacaaaaagagaagcaagcttgtcttctttctgctccattccagctctgggttaagaaggtactaccttcagtattgctggtacaagggtcctggttcaaaccttcagtccctgcccccattaaaatgtaaaactagattcaaccatcacggagtggcaccagaggattgcaatttcatccagcatgatttttattagccttgcaatttcttaatgggctcccctgagggctggctggtagaatcctgcactaccagtccggatttgctacaggcagcttaataaacatggtatcttccccgtgacaattgtcataacatctgaccagggtgcagaaggcagagctaaaggttaacaaaaccactgctcaggtggcagggaggtgagtggggagaatgttggaaattgtaatctgaaggcaaaggctgcctgctgggttggtgattcttccagcctggccagagctcccaggagccgagcaggcagcttgctgccttctataatcagcatcttttacacatctcatcagtgtcactgttcctgacgtctcattatgcaccagaggtggaagtggacaggtaccgaacacttgaacttttacttttcttattatttccatggagcaccatgaagctgggagttaattaagtcccgtgggacaggcaatcagtgtcttttttgctaagttaaattacattatacacagatgcaaaaaagaggagaaaaaataatccctcagctgtttcctagttaatagagtaagttagaaatatgatgatgccaaactggaagctgaagttgatagctccttagcatacgaggtgtctaatgaagtcatatgacaaatccaccagggatctccttccttaaaggatctcaaagcacttttacaaacacttttaaagaacttcctgcctcaactctgacaaagttaattgggggatgatagtcaattcgatagtttagggaggaaattgtactcagccagactggagaagaaaacttccttggatgtataagatgttagactgaaaagaaaccttcagaggtaagacagaatcagacagtgtcaaagtggaaagggagctaaaaatgacctagcccaaaatttcccaaagtgttccacagagagccaataggtgttgtatggaagaaaaaaaaataagatttttatgaccaaataagcttaggaaagactggtttcaacagagtaaaactgccttccttcctgcaggactctccaagcttttaatgtctgactggacatcgatagaatcgagtctgcagcattcaccaaacttacttcactacagaacactttttttctttcttttttttttttttgagacacagtctcgctctttcgcccaggccggagtgcagtggcactatctcggctcactgcaagctccgcctcccgggttcacgccattctcctgcctcagcctcccgggtagctgggactacaggcgcctgccaccgcgcccagctaatttttttgtatttttaatagagacggggtttcaccgtgttagccaggatggtctcgatctcctgacctcatgatccgcccacctcggcctcccagagtcctggggttacaggcgtgagccaccacgcccagcccagaacacttttttttctaatgagacatgtttctttactaattgcttacagaattcacattggaacatgttgattttgtccagttacagatggggaaactaagaggttctttggttttgtttttttgggtttgttgttgttgttgtttgtttttttccttgagacagagtattactctgctgcccaggctggaatgcagtgcagtggcataatcatgactcactgcagtctccatctcctaggctgaggcgatcctcccacctcagactcccgagtagctaggaccacaggcacacgccactatgcccagctacttttttgcattatttgtagagatgaggtctccctatgttgcccaggctggtctcagactcctgggcacaagtgatccaactgcctcagcctcccaaagtactggaattacaggagtgagccatctcgcccagccatgaggttttccccagacgtgcctccaagcacacaggtaggtaacacccaagccttgaattaggacttagatcagccaatctcagaccactatatcataccacctccctctgtaacttaccaggaatctaaaacaccctacaagaatcaggtatgctctctggtcaccctgcgtttctttgtattactttcagaatactcatccttcatcctttttcacctgcagtcttaagacacctcatttccttatgttctcacccctcgtggaagcactgcctgtcatgtaatggcatctgagctccaagagaacagcagctacatgttttagaactcaccttacctgccatcaggccacagctcagcaagactagagttctgactctgatatgggatctaaggagcattttatgagacacagtggtggcaacaaaatttataaagcctctaacagctttattttcctcctgaattaaatctacactccttagtttggcactcaagattgtacatgatgttttccaacctttgtttctagtaactgccttcctggttactttctttcaaactttacactccagccaaataaaatcacttaaacgtaaaccatgttttcccatctctgggactctgtaagactagtctcttagctagtagacctttgttccttatcttcccttatccacatcctggtaatccttttaggccctaataaaatgccacactctctagggagtttccaggtaatttttccacccagaagatttctttgccttcactgattttccataacaaaatacacatatctttattatcacatgattatattttgcttatagcacagttagtgagtttttatatctcccctattaaatagtacattctacgaggtaggagttgtattttatttctctgtagacttaaagcaacctcccaaagtccaaagggatggactagttctaacattctagatattgaatgcataattttatctaggcccttcataacttcatagtttttggttgtctctcaaaacaatcatctgaaaatccctgggagggactcagacaatgcctgggaccctctgagtgatctgtaaatcatgtttcagaaggattaaagaacggcaatttttttttttttttgaaatggagtctcgctccgtcgcccagactggagtgcagtggtgcaatcctggctcactgcaagctccacctcctgggttcacaccattctcctgcctcagcctcccaagtagctgggactacaggcgcctgccacgacgcctggcttttttttttttttttttttcagtagagatggggtttcactgcattggccaggatagtctcgatctcctgacctcatgatcctcccgcctcagcctcccaaagtgctgggattacaggcatgagccaccgctcccagttgggaagtttaattaatgtttgtatagtatttggggagatgaattatgagaaaccgacactgtaacagactatttctttccctagattgctcttttctttattattagaggaaggttctcttgcatagaactgagtgatcagccatccccgttgggagctggtacatcataaaaatagctgctgtcattttgaaacaggaagacgcacatcacaaaagaaacacctaactgactttaaagtcctgcgggccactgaagatatgtgtgttttatgtagtcattatgctttctcatttggttgtttgtttgttaaaagcagacattcctactgaattctaagggagacttaccaaactgtttccttttcatttacctgacttatacagaaaaggtgacttgttttcaccccctcaaaatctcatgcaacagcaaggccttaagttagcaaaaggagaagtgaggagcatcagaggaagtggccttagtgtagctataaagagaaaagcaaggtcattgaggtcaagtgtttgctgacggcaatgtccattctccagctttccacttatcaacagcttcaagacttaccttccaggcatcactgctaccatatttttacccaggtatttgggatgggattagctctattctataagtgcacagtgatcactcattggccaaaaccaatcaacaaagcccattaccctgagcagagggaattttgcccaattaactcaagttggatcaatgagtcatgaagacatatttgttggggggttctggggaagaaatttccttcttctgaactgtgctcatgaaagaccctttcattcccatgtgatacgaataggaaagcaagtaggcctagaagctactgacaaccacattgtggccacagagaaagcaaccttaggttgaatctgacactctgcaaggcagggaagagacatggaaagagccatctcattagtgagccctgagctgctggatcaagccattcctatgactccttagttttcctgtgctgtgagccagtataacatctttatcatcggttctgtgagccaatatagtctctttatcaaatgatttgagtcatttttcccttgtgatttaagtcttcataacaaatttttttaagtaaaatttaaagagaaaaaatgaaagagcataagtttggaagctatctataaacagattatagagagctatggaaatggatgtaaaatatattctttatttgaggaaagtttcttgatgcacaatattccagtgtgtttcttagaaggaaataaatagagacttagcacaggcagaaatgccaagaatagtcatgtctccccagaaacttccactgtttgcaacaacattacaaagaaagtgattaatttctcagtactagaaaatcccacagaggatcttcagggcatcaggactgcagatgagggtggaaacacatcaccgatgacatgggaggagagtgggagtccagaggatgaaaagaggctgaatgatatcaaatgtccagccacctttcctcactaagtcccatcagtcgtttctgcctaatggttccatctcatagcttaacttgtcatacttgccatcaagaatgtaaatccagttctgattccctgtagactcacagaaaaactaattaaagacaccatgtggaatagagtgggtctgccacaaggctgcagagccacttgttaaaaatggtgtcatcagttaagtctggctagattgcacgtggcgataaataatcccaagttttcagcggagcaatacaacaaaagcttatgtcttgttcacacaacatccactacagatgttggcaaatctcttggacagaacaactgtcccccatatgttgaggacgtatgttcagcccacactctgggctatttagtcaacacagaaaaaaaaaaaaggctagagatttgagctccagaaattcagtgcttctacccacattctatacaagtcctatggccctatcaaacttcaaaaggctgggaagggaagtgcttccttgacctcaaaataaagaactggatattggagatcactgtcacagagggaataactgcaaagctgctgcaaattctcttaggtaaaggagaaaaggagtctaaaaaatcaactaagtatccattaatttgaggaggttactagcacttaactggaagtaagggaactcttcaaaatattccaagttattctgcatctcccatcaaagggagaacctgagaagactagtttagtaattataatattctagaaaggagctagagctttctttgtaaaacctatagaatcaaggcatgcctttcctgttgtttatttgtttgttttattgtttattttgtttggtttttttccctttttttaatgtatatacccttcagggtagtttattccctcattaaatggctacttttctcttttatcctctagaaaaaacacatttcctttcttctggtgtagctgaaatgatccattggtgtgtattttatggacaatatcttctcatctgcacacttttctgctgatttacatttatgttggctccatggagagatacaaccagaaagggactttgtggcattgttgggatatccacaaccctgccactagtctaccatcagctaactccagccaaggacagccaggggactagaagaggtgttgcctaaccctcctaccagcaaagcaattcaagaagacagtaactaaaataagctcttagaggagttgtgcctacacacccttatttgacctgcccgaggagattagctcaaagctggaatgcaccagtggaaaaagaacagaaagtggaaaaagcctatgcctgaaactaccattttatagagttaatgcaagttaacatccactcatacatacagtaataccattaaggtcatttctatctccaagtaacagcctttatctaaaaccagttcaatattcttcattcctcccaatgctcctgcctctcccttctggttccccttcttttctcctctaactccctgagacacaggagtttttgtttttgttttttttctgagctgattttcaattcgatgaagtccgtttccataacacttttaatatctgaataacccattcatctttacccaaatttcttcaccttccaggctccagctgctctgcgctatctggtcaaggttccctacatttcctaataaagatgtgcatgttaggagcagttactgtggctctttaaagtaagagcagacttcagtgctgtgggaataaaagcaaggtctttggaggggaagatttatggctgaatcaacaagaattaaaaagaggacaaccctgaggagaaaacccaagttctccaaattgactgaattgccttttgtatctcaaggctgagatgattatttgtttttgcaaatagaaatgctatgtatattagactcaaaactgataacatattagagctttcagcaaaataaaaaatgtttaacatgtctagtatagaaccacatatccaaacactgatgaaattcatattactccttactcaacacaaatacacaacacataccacaaccaccaccactaacacaccacaccacatataccactgaaacccattcaactactatctgagacccttcatacctgggaaaggaacctactcatagttgggtgcctttaattcttcatcaggcttcagggagatggtagtttactactatgcattcaagaaatggacctgtggaaaagcaagcttttctcgcacatgaagaattaaatatactgataaaataacatattgacatatcacagttttcacattctgttactaaggacttccataaaatctttccatgtcgctggtcgagaaatagcaacttgagattacaaaactgagttatccagtcacccaatgagtcagcaagtaaactaatttgaacacttctggttcttcaattaccaagcctcacctcccctgtagaatccaaagaatccccatgtgaggccattgtaccatctatagcaatttcatagcaagcaggcctctctgcaggatagctaaagtttcatatttggaaaggctcagaaaaaaaatgtaagcattatactcctatagtcaaaaacaaaaatcccatgacatatggtttcattgagaaaattacacacagtatttatttagaaaaaaataatttcaatttatgaagttgtactttagaaggaaataaataatcatgtcacattccaataggactaccttttgtctgtcattcatagggacattttcacagggctaataaagctcgcggttttccactgagcacagaaactgttattttaagataaaagttaagagtagtgtagctgagataatgcaaactcctatatggtgatgtaataattactcagtgatattataataaatttaaacacattgtaaagaaaaataaggacttttgggagccaaaatatgacaaacactcatcaaaaccacagccttatttactgataacatatcttgatatgagaggagcaggctaatatcataaactcatttgatacaaagagtccctgagaaacaaaagaggcacaattaacttgttcagatgagtttaagctgcattcaggctaatttcctgaattccctctttttttccaattagatatatttttatttatgtgtttgcagagtgtacagtttcaaacacaccaggggactgtacctaaatcatttttataatatcatatttaatgggaaattcaaagttgaattattttaacattgaatacagaaacccattcatatgattctaaatacttttggcatgaaatataactgtgtcattgctgaatagttaaaggtaacagtttatttcatattattagatatagcagacctgccattccatttctataaaataaaaatgcattataatgtttacattgattaataataataacaatacattaatagtagtaacaacatattacctaaaatcattggtaataatgtcctagggcaagaagattgtacaaacctaagaactagattttctttcaaatctttcatcatactcttgagagaaagacaggggaaaaggcaagaatttcttcctttttttttttttttgagatggagtctcactttgtcacccaggctggagtacagtggtgcaatctcagctcactgcaagctccgcctcccgggttcacgtcattctcctgcctcagcctcctgggtagctgggactacaggcgcccaccaccacacccggctaattttttttgtatttttagtagagacggggtttcaccgtgttagccaggatggtctcgatctcctgacctcgtgatctgcccacgtcggcctcccaaagtgctgggattacaggtgtgagccaccacgcccagcctccttcttttttaaaaaaagaaaaaaacagcaagaaacagaggtatgcaaagtcttaagttcaaataattgacaaagcctctttcacacggcaagttctgattatgacaacaccaccataaacaattatataaattgtgacactttaacttggcataacaatttacagagtactcacagactgattatctttcataattgtgtagtctcattatgtatttaaccaaaaatgataatccctggcacatttccagggctgtctatgaatgagacactgcgttaagtgcactacatgcattaattaattcttacaaccctacaaggtaggaattaacagactcagtgaagttaagaaaatttgcccaaagttatataacaagtaagtagaaggatcagcctcaaatccagttttattttagagtccaagctcacaactactatatcataatgccattgttgaacttttaggtttctcctactattatacgtttataggtactgtcttcctccctccaaaagctggaagtcagctagtaccaatcaattgaaaggttaagtgagttgttaaacagttgtagtcagacagggacattgctggaattagaagagaggccccaggagtcctgttcactgtgcatcctattctgactaattaccctaagaaggcaaagccctttcagatgtgaaactgtctgcctttccagcttctcctccccctgaagtaggtaattctcatacatttggagcctcatttcagggagaaaatacaggcacaagggactcagtaagtttcctccaggacagccaggtcaggggtcaatggttgagtttctataccccttttccctaatctaataactagctcaaccctgctttctgcagcacttctctctgcaggcacacaaccctgaagatgcacactaagtgggtctaaaaggaaaaaaagaaagaagggagagaaggagaagacaaggagggaaggggagggaagacaaaagggacaaaattgttttttgatttctgtaataggagaaacaaaattaattagggaataaaaagtattttcaaattagcctctaaatagctatgtatattataaagaaaatattaaatttgtcacatagctggattgcatgaatttcctagaagaatctccttaaacaaaaagtggggataaaaataagcagtgtggtttgccttttaaacagtaatccagtacagacatatatgccttcatccatccattcatcaaagaggaatccaatatgaagctcactctcagagagtgtaatgtctatttgggagtttaaatatttaaataaatacatgtaatttaaatgtaaaagagataaatttcttaaaacaagtataattaagaactatggaatttcccaagagaaaaaaaattcttcaactttaagaaaaggagaatcttcctaagggagatatgcattgaagagtctaaatgaattttaaaatataaatattttggaaaaaattatgatgacttaaacattagggttgtctgagagctattttgtagtcactagaaaaacagacgagatgagaaacctgtggagtcttggtcttgtcaaatcaagtaacacacttaaagaccacagctttaatcaaagtacctttaacttaagaaaatgatctctagtactaatgatagtgagctgtgaacatgaggaaggtgctactcaaccacaatatttatctgcatctcccctttcccttcctacttgtgatctataccagttgcctgcatttccttgatactcatatactccttaaccccccaaaatctggtttttctccccaccaatattgtcctgtggcctcaaatgtcactaaggacctctttattgcggtatgttttgattagtctcaacacacattccttcaaactcttccttcacctggattctatgacactaccacaagaattttcaaacatactgttatcaggagaacctttctttcatataagatcttgcctagaacttcaactgattaccatagctttatagtaagatttaaaatcagactgtaagtcctccaattttgttccttttcaagatagttttggctattttagattattgcatttccataattttttaatcagactggaaatttctaccaaaaaaacctattgagatgttctattgaaattgcattgacttaaatgttaatttggaataactgacatattaacattattgagaactccaataatggttctctttatgtttcttctgctttggattcattaagcttcttagatcggtgaatttgtagttttcaccaaatttagaaaatctttgcatatttatttatttagatttattttattttctatcccttctacctctcttttccttctgctactccaatgacacaaatattagactactttatattgacttagagattactatctatccattttttcccttttctttctgttcttcagtttggatagctttgattgttttgtctacaagttcactgatcttgtcttctgcaaggcccaatctaatattatctagtgaaattttcagtacagatattatttctttcaattctataatttttattaatttttgaaatagttttcattttcctgctggaatttcctataacttctcttgttgcatctttgttttcctttaaaacctttaatatgcttataacagttgttttaaagtccgtatctagtacgtttcaacatctctatcatccataggtctgttttagttgattgcatattttgctttttttctcaggttcttgattgtatgctggacattgtggatgccatgttcttgaaggtggagatttttttatcttccttcctttaaagggtgttgagctttgctctagcagacaattaatttactgaaataacagtttaattttgttaagccctgttttcaggatccattcagtgggtctagagtagctttactccagagctagaatattttattcctaaagtgtggcctttctgaggtctcaactcaatgccctggtgttgagtggggtttctccactctaatcagtcagcatttgaaatcttctagtactgtgctgttccaaagtactcccagtaccttagaggctatgttcacttcaagcctcccagtagctatagcctgctagacctcacagaaatatactcactacatgattggttaactatttggcaaaggactcaagggacccctgcagacttctagagttccttttttgcacagctccctcctctctggtatccttccctgcaaattccaccaatattagcagccctaaactctaatctctgattggaaactgagagcacagagaaatggaacccaaaaagagttttttgggtttccctgaactcaatctcagacagaaagccacattccttgactattgagtgtgttgcctctccattccctctgccatttccctgccccagttatctctcacctagctgagatgcttctacctctcgtcggtttaccaatcagttcatccatacctcactgccagattaatgtgactatagctcacctttgatcagtcactgactccttggggattacttgtcacctgctgaatcaaaggaccaaatgcttaactctagatcacaatccaatcctagcccacctttccaaacctacaactcaccattccccttcacacacaccatgctccttgctattcctgtgggttctagccttgctgccttgcgcatgctggttcccccaccagaaatgcctttcctctgcatgctgaatacctaaaccctgtccttcatagcatagcacaaatgccactggcgttaatagagcttagttggctgccccacctgaagatgacctttcccaactccgagcccctactctgtgagaggggaagagcatggcatacacaacacttcccagagtgaaggcagcaggacagatgccagccccaagagaaattctgggaataaagagttccacaggcaaagtttaggtaacagtccacaccacagcactccctagaaatccacattatgtattcacgtattgaaggatcgcaaaagtcctttggtaggaaaacctacgtaacttttttttttaatttgttttggtttaaacttttattgccaaccttgaaaagcaacatattaaccagttatcttgtgataagaggacaacttgccatttttcttagaatctagtaggcagtcctgcggccctaaagcatgtgggagtggctttttgctcacttggctgtacccctcaatgggaggaagcaatggaaagaaacgtttagcttacaaacacatcaggacctcaaattaagttgttgagccacttgatattctttaacaaagtaagtactgatcttatcaatcttcccacactgcctcacgccctcccatctaggtcactaaaaaattatatatatatatatattttagacggagttttgctcttgtcacccaggctggagtgcaatggtgcaatcttagcttactgcaacctccacctcctgggttcaagcaattctcctgcctcagcctcccaagttgctgggattacaggcaccaccacgctgggctgattttttggtttgttttttgttgttgttgttgttgttgtttgtttgtttgtttgttttgagatggagtcttgctctgtcacccaggctggagcacattcgcaaaatcctggcttgctgcaacatccgcctccagggttcaagcaattcccctgtctcagcctcccaagtagctgggactacaggtacccgccaccatgctcggctcatttttgtatttttagtagagatggggtttcaccatgttggccaggcttgtctcgaactcctgacctcaggtgatccacccaccttggcatcccaaagtgctgggattacaggcatgagccaccacacctggctgaaaaatatatttttttaattttttatttccgtaggttttgggggaacagatggcatttggttacatgagtaagttctttagtggtgatttgtgagattttggtgcatccatcaccggagcagtatacactgaacccaatttgtagtattttatccctcacccacctcccaccctttcccctgagtccccaaagtccattgtatcattcttatgcctttgcatcttcatagcttagctcccacttatgagtaagaacatacgatatttggtttaccattcctgagttacttcacttagaataatcgtctccagttccatccaggttgctacaaatgccattaatttgttcctttttatagctgagtagtattccattatatatacataccataatttctttattgactcgtttcctgatgggcatttgggctggtttcatgtttttacaattgcgaattgtgctgctataaacatgcgtgtgcaagtatcttttttgtataataacttctttttctctggctagatacccagtaatgggattgctggatcaaatggtagtctacttttagttctttaaggaatctccacactgttatccatagtgattgtactagtttacattcccaccagcagtgtagaaatgtttccttttctagtgttccaaggttcccacacaaggaattcttgaatttggaacagggacctggattgtagtcctgattaagcacttgttggtgctggtcttccccacgcccagataaccatgcatcataatactggtggcatgtttttcccaggccaaggtagggaaattgtacatcccaacatgggtagggtaaccatgtatcacatatgtatgacaagttgttctgttcccaagcccaggtagggtaatcacacaccccaacaagggtgacatactatcccagcataatcattcattgtgaaccttgcactctcaaaagcatcctggtttgggtgataaattacatagtcacttagttataagccctccacctatagacttcattatatccagttcctaaatcaaaccaaaccaccctaacaagagtagaatctagaattaacaattttcccattatacagaatgttgtttttctggactccaggccactgtgtgccagccatagttatttcctaacttccaccatattgatccagtcgatgcgacaggacgtgtgcctgagactcttgttctattctttagggtcccattggagctaaacgcagccataagttcagactgagtttgccataaatccctgccattgttccctcgtgtgcttctggctacttgatagggccctgctcccaatagactgttcgaaactatgacattatcactaacacttgagtgtaacacatcacatctgaaacctacaatgatggtacccatctcctctttaccccctcaggactggagttccctacacactggcactagacacattcctagttcctaaagattaaatggcttacttcccccacaatgactatagccacatgggttatgaggccagataactaccggtgtgacctttatcaaccacccctcattatgaatctcagttaactcatctctgaaatgaactggccggtctgtatggcatccaacattccacccagctgtgatgaattgactctatgtacccttttttgaaacttaactacttccacataaggcctcacttcccaaatatctcttaaaagtggggtctctttccatatattttttaaatctccttcagaacatggtagagaaccttgaacatggttggaactcaaatgtatgtcacataaggatttttaaatgagtgaggcatttaagcctaaaaaaaatcaaaattagactttgagatgatgggaaattaaataaatctaagaagtgaaatgatctggtcaaagcagcaagcactatagaaaaataaattcatatcattttctagcactatgactagtgaactagcactgccaataatggctaacattggacatttaccatgtgtgagatgcagctctcagtggcgcacaccaaccctatgaagtgggaactattattgaccctactttacagatgagaaaactgaagtacagagggtttaaagaacctgcctaaagtcccccaagaagcaagtgatgtattcaaacccgggcagtctagctccaaagtccatgcacttaaacactaggtcagcctgcctctccctctttcacaagcatttgcacatctaagcatcccaacaacaccaggttattacgcacccagcagaaactgaggcccagagaggcttaaagatcacccagtgtcacacagcagtctcagcgcactacaatacacttttgaaatgtcactgacagctgactgctgagaaacaggcgcagaataaagtggaagtgccactgggggtcagcggctctggagagaattaaaattggtagtaaattgaaaggaagaggtgtttgtgggggacacgatgaagcgagaagtgacagccccaggctatcacctgaagggaaggtcaaggtgagggagaagcctgcagaggccacagagtggacagttgaggacccaggagcatggaaaggtaggcacggaacagtttagtaaggacagaaaaaaaatgttgtttgccatcgcatacattttcagcaccagtacaaaagttatagaagaacacacattttgaagccaggaagctgacttttggattaggacagtttgactgcagcagcattcacaagagaatctggtacggcgagtgccacataataggcactcaataaatgtttgttccaaataaaagagacaaaaagagaaaaatctgagaactgctttcataaagagaaaggcacctaagggagtaggtgctcaataaatattattttttatctttgtgccgtgagaagcctggggagctgtaaaagattatctgatccatttccaaagagccctgagcctctgattgcaattctcgcaaattcccggggaaggctgtggaattcctctctggagacttacaaacatgcttttagaagagccacttggagggagtggtttagacaatttcaaaatgggtgaattgaggcagagaggctagaccgaatgaccctgaggtccttttcgtttctgatgtccacgtaatcccctcagaagctgaagtttccactctgctcccccatggcacagagatgaaccgaatggacctgcagacattgctgtcccgccaagctgaggacggctgagtgatttggaagccttccagtaggatctggttaaatcgtaggccatttattttgtgaagaaataaaccacagagagcccctttcaaacatgcatacagaaatcaggacaaaatgccaagcagattatctgctcagaatttgctttgaaagagcccgggcaacactcatttatttttgagaaaatatatgattaaccagagttaactatgaattcagatattgtgcattagaccagcttctcaaagtttgagcacatttaatattatatatcgctgccatttggactaaattgtttttttaatgtacacaatattacaaatttaatttgagctgtttgaatcagtctgtaaaaaagatttgattatacctgagtgttctggccccagcgtttccgtatctcagtaatcttgacggtaattggctgattgggcgtctcacactccatctctgcctcagtttccatggtaatgttacaggagctattatagatgagaacttcatctctttccaatttagggctgaaacgagaggggaggttaaatggggtgtcatcaatcttaatgaaatgcaattatttttactcttattaatcattgcaagccattagcttgtggcaactacaggccaccatttgtcaaattttgcaaatttctgtaattttgtttccattcttttattgtttatttgtttttccttttatctgcacaccctgcaatgaaaatgcaccatggtaaatatctttcactgaggcctttctcttttccgaatctattaaaaacattagcaaaagctactcctagcccagcttaacaagaaatgcagggacaatacttccagttccaaaaagggtaacaaacgtctgggagagtttttgtttttattttttttcttttccccttccctcttcctgctcttactcatacttagtgttgggggagtaattgcctgaatccccctagggcagatggagaaattggaaaacccacacaactggctaactggtccctaattccaactgtgaaaaaatgagctcatttaggcttgcaattcccccttcccagctgatggcaatgaggctctgttgctagcagtggaacattaacttagtaaattaattaaacttacttaacagcccagactaaggagattcaatatatgtgccagttatactaccagccactcgctttaaaagtcctcttgctttaaggggagaagccagactggatttaaaataaaaaacagcagtgtagcattacagaaagtctaaaaatatgccatctagaggtgaggacatggatagtgaagggtgtcatcctcaacaggtgtgatatttattcaagaatcatcctggctgtaggcatttttgcaactaactcaaaaattatcagtaataataatgcatgatgtttcatatttgtcaacaatttcacatgtatgatctcatttcagcctataaattaggaagaggtgtaaaaagtgtaacccaaagagatcaagagattctcagaaagtcaaacacagaactacggtagctccgaggtcaaaaccagatggtcctgtttcccagagcagtgctctcaagttttgaaatgctgattgaacatcagccaggaagatggcagatcccatgggaagaccaggaagggtggagagaagggcaaaaaggtcaccacttgagaaactgtacaccatgtcaaaccctaccatcttttttcaaatcaatgtcaaaatgttttcttccacaattttctagaaataatgagcaggataactagtacatctcaccacttaatcttcgcttcttcatgctaaaatattctccactctgtatctacctaagacatgacttccaaacccacagtcctttagacctaataatgtagactgtcaatatgttaacatcatgccacccatatctgaacgcagattgtttgggctgaccactgggactccggtctgcctttatctgagcctccttctcacggtacctgatactgtgttcattttgaaggccaccgtgcttatacttagatagtggtcaattcaaagtctcagagctgcagctttctgaggatttcaccatggtgtgtttgttcaaatgattttctgaggagcactggcatgtaaagcttaggctcagaagcagatcagctggatctgaatcccggggcagatggttaccatctacatgacattgaagacattacttcactaagctttggtttccacatttataaaatggagttgccaataatcaagtacctattttgtggaggtgttgaagaaactgagcaaaatgaagcatataaatagattagcatggaacctggcacacaatacgaatccaataaaggcagctcgcgttatagctgttggaggtagtagttttagtagcattattgttaaaaatgtaaatgtggaaatttacatttattattgttacatatctctcactggtttagacctgttgctcaaatttgttttgaatctgtagcctgctatctagctgtaaatccattcgctgatccttcgtccacagggcagacaaagtcacaggataaatccatcctttgctcctggagcatcagtcgtattccaagattcagaaaggaaaagcaaagtaatttaacttttaaattaaaatgcaatgtaatatttagatcaatacagaaatgtgatggaatcaaatgcaaaattcacgcagacttttaaaacacctcacttcagagcaacttgaggcttgcatcaggccactttgggctttgcacctagaacctttttttgttactgggggtggagaagtggttggaatagtttgtgaaggtctcccgctatgtttatatcataagtcacttataaacctatcagaaaggaaatgaagttggtttcccacaccatcacattcttcgtaaatcggtttccagatggctactttcatttctgaaggctcacaaactatctgatgaatagttcattctagaattttgtcagggataacaccaagcttagttgtctaaatttccagaattcctcctcttttttttaggttcatagaatatctgcccatcacctctgttatgtgaccccttctcatggttcattgccagcaataggtcctcaatcataagagtgagttttttgtacccagtttatgaatgatctgagactacagacttgaactcaaggaaagtagtgaccaacttccttctacatcctttcttggccttgggcttccacttgcctcataaaccttcttatgccctttcctgactcttcgctggcagaggtacaagtaaaatgggctgagtcactctaccctctgtttgcctgttaggaacacactgttttcactaagcatgttattcttgctctgaagagaattaaacccctttctgttagcttggactttttgtttaccagcttcagctcacacttttttccatatttgtaactaccttgctagaaatgtttttcattaaaaagccatcaccaaaattagctgagacaccaggatatccaaaataggttaacatttacaaaatttcaaagcttctaaatagctagctactcttccatggtttcttccacaataatcctatgaattaagaagcacagttggccatatttaaatataaatataagcatatatatatgcaacataagcatatatagacagagagatcaatatatgtacagatacagatacagatatacatgcatacacactgcacacacacacacatatttactttgggggatatggtttaaaatattgggtaaaaatggtggcaaagattgttctagtatctaagactcctgactcccaaactattgttctttagttgatctgattagatcctaaagtaagcaagtaaccttggctgtgctccttaggataggtagggaaaacaatttgcaggcattttctctccctcacttcccctgaagttgcttcctgtggctctgaaacctcactgaacccacaaagctcagccagggctctcacactgaagctgccagcacagcattgcactaagcacactgcatcagaagccttgagttccagtctcaacactgccatggcttgactgtgtgactttgggaaattacttaatcttcacttagaagagaatccaaactctttactttggccttcaatgccttacatatctctccgagctcatctggggccacttttcctccttctcagtctactcccaccctcctagcctctgaacagtcataaaactcgacagttcttttgcatttgctgctgccactgcctcaccctccataaagacacctgcttctcttcgtaacataaaagacttcttcagagaagcctcctctgagtacactctctaaagtagcccccctttatttttctatcactttatagcacttatcacaacacgtgatcatcctgtttattatctgactttcttctctacccttaaggggcagggactttcatgacatccacgaatgagccaccagtacctgtcacaacacctagaacagagtagggatgtgatcaatactggatagatggatggatcatggatggatggatggatggatggatggagagatggatggatggatgaatatactggataaacagatggatcatggatggatggatgaatggatgggtggatggatggatgaatacactggataaatggatggatcatggatggatgaatggattgatggatggatggatagatggatggatggatgaatatactggatagatggatggatggatggatggatggatggatggatggatggatggatggatggatggatggatgaatatactggatagatggatggatcatggatggatggatggatggatggatggatggatggacggacgaatagacagggtataatttttgccacagatgcacttctccctttgccaaatgacatcaaaccccatagatgttgtggatggcagggagatacagcattgtgttccctggaaaaacacataaaaactcaatgaagaaaataaatatggtcagtactccaaccacctagagataggcaccatcaacattcttggatacatctttccagccttttctctagtaacctatgtgtgtacaaacatatacactatatacaacagtaggatcaaattgatatactcttttgagacctgtgattttcacttctcaatatattataaatatttccctgtctggttaaatattctacatcctaatttttaaaggtgacttagtatcatatcatttggatacattctttattactaaaacttgtttcattgcaaattttttttgatacctgaaacttcaaagaacatgattgttataaatattacacatttctatctactttcttaaaatcctaaaagagaaattgctgggtcacagagtataaagaatttaaggttattcgtgaatcggcaaattgtcctctgacgattgcattaccttaccttcccactggcaaaaagaccgctgccagtttcccccactctcatccccattaaactttgtttgtttaaatcatagggcacttattataattcttactcaagaaaacatacccacttttggccgagtgcagtggctcacgcctgtaatcccagcactttgggaggctgaggtgggcagatcatgaggtcaggagatcgagaccatcctggctaacacagtgaaaccccatctctactaaaaatacaaaaaattagccgggcgtggtggtgagcacctgtagtcccagctactcaggaagctgaggcaggagaatggcttgaacccgggaggcagagcttgcagtgaaccgagatcttgccactgcactccagcctgggcaacagagcaagactcagtctcaaaaaaaaaagaaaaaagaaaacatacccacttttgcctactgcaatagccagaacattgagcagcactattgaaatgatattcataggtaaagctatactgtcaatgcgttctgaggctcagttgcttcagccatcccatacaatgaagaggaagagcatggaagaaccccaaagaagagttttggggattcagatgaagtccctgaattcaatggagccaggacctactgacatgtacttcctggtgtccagcatcagtaagttctgaaatccagtctcacctgagtacaatacccagcactccatttcctgtgtgagctaaacagagttcttcttgcccttttagaaagcaaccagccaaggaggttcctcttttcctccagctaaacctaaacctctggtgccaaattcacactaaaacacaaactgtctcaggacatcacaaagtcagatgccatgaaaagagctggttatctctttcaccgtggggaagtggtcttgtttagtttcatattttataagaaaagaggcggggcacggtggctcatgcctataatcctagcactttgggagaccaagtcgggtggattgcttgagctcaggagtttgagaccagcttggccaacatgatgaaaccctgtctttactaaaaatacaaaaattagctgggcgtggtggtatatacctgcaatcccagctactggggaggctgaggcatgagagtaccttgaacctgggaggcagaggttgcaatgaaccgagatcatgccattgcactccagccttggcgacagaacaagactctgtctcaaaaaaaaaaaaaaaaaaagaaaagaaaaagaaaagagaccttcattagataatcaaaggtagccactctatctacgtaagacataaagaagtttacatgacaatgttcagtcatgagacactgccctgtataggaaaggaactccttgctgaaatgaaagcaatccagaattactagcatggtcacacttcttttttatttgtttagaaaaggggggttaacttggaaagttgtggtgtttatttgtcagcctcttttttaagttaaaaaaatgcttatacgcttatggcttctaaatcctagatctacagtaattccgcctatgcaaccctccttcttttgaataaacattgtacaatctgctggatttctctatggctttttttcatacttgtgaatctgtttggaaagaaaagaaaaaggaaagcggggaaaaagccttctgtttttcataacgtctaatctttttccccattggcattcaccagatgttgctttggatcggaagataaatattaaaatctaagcaagaacaaagcgagctgtttactgggcagatttttcagatgttctcttaaacagttgaaaaagacaggagatgctttgatatgcaggctggctggaatccacaatggaatggcccctccaagagagttgtagcccttaccacggctgccaggccacatccacccagcctacactctctgatggctccatcggtccattggccaagcatttgtggggaagttcagggagggagaaggtaaagttacctgataaagaggcccgagaatgatggaaacattgactctgcccaatgatctggcacaaagaggcattgggaactttcctcgcaaatgtagaggtaaggccacgattcaagcagttgctctgtcgccatggcaactgtcaaatcacactgcacataggtgtgtctggcagcctcacagctgtcctcctcacgcttcaggccacacaggaaggccaaggacactgcaggaaacagtcaccattaggaaagaaccacagagagaacctaaggcctctagtcggtttcacaaatgaagttcctgtgtcctcctttgaccaataggaatatgaagttagcagtttactttttttaaaatgtattgtatatgtgtaatgtacacagaaaaatacaagtatcatttttgtaaaatatgaataatcatcataaaaaaaactcaagtgaatttcccagccaacataagatataaaacacttataatacacttaaatctgtgtgtttctccccaagttcgtccctttcctcctcattctcagaaataaccacttggcattttttaaatagttttatcacaaacatttgtattcctaaacaagagattgagttttccttgtttttgaactttataaaatatgatacatgataaaatattcttgggtctgattttttcattccatattatattttcaagatttatccacattactacatataactattgttaatacattttcactgctgttcaatattgtattgcatgaaactaccacaataaatttatctattctcttatcaatgaactttttggtatttcctagcttttgctactaaaaacgtacaaaatttcatctagggtgcatgcctatcaagaaaatttcttattcaaagagtaggtacaagttcagctttacaagatagtgccatattgttttccaaagtagttgtgccattttgtattcctaccagccatatttgtaagttcccattactccatataattacaagcacttgaaattatcagacttttaatttttgccaatcaggtgtgtaaaatggcatttcactgtcgtcttaatctgcatttcaatcattacttttaggttgaccaattattattattattattattttttgagacagagtttcgctgtgttgcccaggcttgtggcacaatttcacctcactgcaacttccgcctcccgggttcaagcaattcccctgcctcagcctcctgagtagctgggactacaggtgcacaccaccacaccccggatgatcttttgtattttagcagagagagggtttcaccatgttgcccaggctgatcttgaattcctgagctctggcaatccacctgcctcagcctcaaaaagtgctaggattacaggcatgagccaccgtgcctggccaagttgaccaacttttttatgtttggtaacaactcatgttttctcttctgtgaaattcctgtttctctcatttgcccatttttctattgggttgtttgtcttattgacttggataagtttatgaatttcttgattttcacataattataaacattagcatgttatagagataaaaagcaagtatttgaagcatgctgactctcaggccatttttttctgagtcatgacccacatataaaaagcatcatgaggcagactgggaatgatctttaactagaagatgaacaaagctccacatgagatggtttaggagcagctctgtctgaaaaccttaataaagagggaaaatttaaaaaaatctctgtagcctgcttcctctgcagcaagcctgcccatgtgggtaatgcaacagaggttatcaagggccgtgggcttagacctgtgcttccccgcctcattacagtgctgtggcaagggttacatgagataagtacgtgggggagggtttgtagttatgcaatcatgcccaaatagtactattgttgctgttatattctaaagcacctggcacctaggaggttggctgtgaatgtgttttgaatgaattagagcaataaaaatgactgacagtaggactcttgtatgaacagacaaaacataagaactttccagttagtaagccctaaggcaaataaaaacaagctccacacctataaaataatgaattcattaaaggtgattaagtagatgcaaattgacaagcaggattatgaaaatcacccagggctggggatcaaaatctatgggttttactcaaagttctgccactaaatagctgcgtgaccttaatcactttagctttccatgccttatggaaaagttaaagtttccatgaaaatgtcatgtggtataattcaaggtataaatgcaagaaagccaaagatcaaagattttgctcattttaaacaaacacaaagtattagtttcacctaacaggatgttttggcaactcattacaagaaaaaggaaatttctcctatggttagaagtacagtttgtggggatggtaaaaatgggtgacctccaaaatagcaaaagcacatttgtagagccccctgctttaactccccctgccccacacatgtaaagaaaacatattagttctgtggcacaggcataaacaaaacaataattaagaacgtttgagttcagggtcattatctgtaacctggaatgtgaaacatcactctatggtacaaagtcaaactgaagaaaaaaactcaaagcacgggtcagaattcaaagcgaccttggtaaatgagagaagttaacagaaataaacaaaagaacaaatgaaaagagtaagacagtaaactacaaaagaaaaaaagaaatcatataaatatgaggaaagtccagctgtgcacagccatggtagaaatgcgtgcgtgcacacacacaccccttgggataacagtaggtaacagaaagcttattaaccagcaagactgcagtataattgtacaaacaaacatgggatcagacgatacacaggcatcttacgatgctacccaatttggccagaacttgcttgtatagaacagcttcctcatttggggcttcaaattaggaaagaatataggatttcagagagggctgaaaagtgagatactaaaatgtttacttggaaagtttctgattcagtagggcccaagaattcacatttctaacaagctcccgggtgaggcccttgcagctactgctctgggaagcacacttccagaactgctgccatagaggaactaagaatactccactttccaaagaaccacccgctgattaaggttgaaaaaattagagtaggggagcatccattaggcagaggatggatttctctgaaaagagcaactgcgaaacacttgtaagggttgctgctgggaaattctcccctgaaaaatctttaaaaatacaagtgatttttagctaacttggttgtactcaatcctgtctgaaaatggagaaattagtagtagtttctagtaatgtctaagacctatcccctttgacatttgatgtccattatagacctacttcctagggaaaaaaaaaaaatacacagtcatacactcaaaatgcttcatccagtttcagcgggttaacagaatccccaaatcccatcttggatcttaagtaagaaacctctggagttggctctcacaatttcctctcaatctttagacattgtgattgaaagtcttttaaaagacttttttatgaaaggaaaattagttaaattatgcattcctctagagtaaatgtgtgccttgcacaatcaatgagtgtttggtgacacctagtggccatataaatagttacagtttccaactaattttcctctttaaaaaatcatggaatgttgagttcttttctaaatctttctaaacacaataattattttattattcttccccaagaagttataaaacttaaaatatcacaacttacctgatcctgaaacatcattgatttttatcttatactagttgaaattaagtgttttgaaataataacacggggcttttaaaagtatattaatttgagcagtgtatatatgaaagcttttttaaaaaatgtagcagtattagttaaaaattagagcctataaatgtgcagtcttagctttctgtttatgctatctctcatttattcctcaccaagcactaattttgcacataccctctgcaacactgttcctagcagaggaggtagagcagtgaatcagacaatgttttgaacttcaatcttctattgtatcttaaatttcccattgtggactctatctctcttccataatgtgtttatatacatgatgataataggaaactcaatttctagcattttaacaaaaatttttttctcctccccttcttcttcctcttccctcttccccctcctccttcccctccttctcctctttgtataagacaacacagcacaaatttccatcacaatagcattatccatcattaaattctcatccaagctcagatgatgtggtgcttttatcattttgtaaatctttagcccacattcaagttgcagacaaataaattaggaataaaacttaaacactacacagaaaggaggtatgtaaacggttaagtgcacaggtacaagatttatgattaggcaaataaggtaatcacctggctaaatgtgagctatctcaaatgtagtaaggtcctgtagtaataacagtaatttcttccttttgactttatttcctgaagctcagtggggtattaccatgtgttgtgaatccccaagctttgcaacttactctctcatctctttccccacaaagacacggcttctcataccacaatttatatgatcactacgcagcttaaagtagtgagcaattgtggtgttttactgaataagaaataagtaattatgtgagtattgcaaaacaagaagacaacatgagtgttggctcttttgcctataataagaaaccgaaaactgaacacacaaagctaattttcaagtgatatccagcttgaaaatctccatccctttactggtacctccaataagcagatgtcttcagcaacctcacctcagaacaaagccaagagcttgtttcctccatgactcctatagctgtcattgaaactaatattcagaattcagaattacttcctctgtcatcctaagactgcagttaagaacacaggtgataagtgtttcaatattcatctaacattgacatattaatatgacaaaagttatgatgaatcattttaacaggtggcctcagattctaactatcattttagatgaggagtagagaaattcttttcctaggcacacatagagaaattagtagtcagtacagcattaatcacaaaaatagaattaaccaaagaatatcatttccatatatatgctttaaaatatatgtgtgtggcatctttactcaccatccaggggcagaaccaagcagctgaaggcagacactgtagcattagccaggactcggcagggagcaccacacacagcagctgagacattccctggagaaaatcccgctccaaacacatgcaccagccttccacccaggcagcctttaaagacaaaggtacaagttcttgatcatacaggcaaatctcccttctttactcaactcaaaattcaaacatttgcttcctcactacccattcttcttttcacatcctcagaatccgcacaactggcttgaggtggctgctggcctcagtttcctctccacttaggctctggccttgtctgactccaatcacattcaatatcctattgtgttaaagaggtttttttttaatgtaacaatttttatatggaaaattaatgcttatttatagtttttaaactttttattcaaagagccataaaatgaaaataaaaattcccccaaccatctgactccctccccggaggtacccaggtatagagtttcttatggctccttccagaatttttaagcatctatgtttctgattcaaagcattattctatccatattattctggaacttgcttttttgcttcaaagtatagcatagatgttttttcaaaactctatggatccagttcattttagtagctacttagaattccattatagggccctgctacaatttatttgacaattttcctatttattgaaatttccattttttctcctcttttgctattgttaatagtgatgcaataactgtacatgttttgggacatttgtatgagtaaaaccagtccacatttctagtttacactgagatacagagttcccctcactactgccttcataccaggtctaggtggtacttagccacttgactaactcaaaaataatgcttttggtttaagatgcatttcttatttccctgctcttccatcataaaaaaacatggaatcttagggagtagtgcctttatcaaataaggaagctgagtctcagaaaagtcaagcataaattagcaaaattagtgatagactagagccaaatcctagtccccacagtgttccaccaagctgagaccaaattttttctaagaaatgtcttagttagtactccaacagtctaagattctgtttctatagtttttttccttactttctaaatcacaaccaaatttgaactatctcaagtgcaacaaggctttaagtgaatagaaattgaaagcttttcttcactggagggaaaggctaggcaatttttggtatatctaaacggagaaaacagtccaaccaatttaattgttctgtgcatttggcttattattgttgaaatatgagtccacctgtgaaatattacaaaatgataaaaatttaatcatacttaataaattttaaacaacgcaaattggcagatagggtctaaaactaggtgaaggcatttacgttcttaaatgatcaaattatgagctcttacaaatggtgttatttaatttaaaatacaaatccagttaatgcatcaaattaaaatacaatcaaacatttagagaatatgcacagtttccttgataaaaataaaaaaaatcttcataaacagagcataacaaagacaagcctcaggaaggaattgggattgtaagaagccagtgggcttctctttccttccatcaggcagattgtgttaattttctactttccagaagtgaaaggagctaccaattcatttacataaagaaagtgtgctgtcttatttgcttgacttaccgaagttctccgtcactgctgtaataataactcttgaggtgaacaccagggcagatgaggcccaccctctgatgcagtcatagcctctgacgtggtactccccggccggaagggaagggaccacgcactgaagaacggtgtggttaccagagacacccacacagggtgacattcctataaaaatgtcaatgtttgcagctcctgagatctgggccactgcaaaggttaagatgtcatcgctctgagaaatagagatcaattctggggtaaaggccttgttataaccaatgactcctatgtgataccaaagtccatctacctctatttccagggcaacagagccattccctgtgggaacaatgcaccggatgagctcagcaccgatgttcaccgtcaggcaggtctgctggtcaatatagactgacgtggtgttctgtcctctcaggcctgtgccctctatggtcaagaggcttccaccatgtaagctgaaattcttaggaaaataatgaaacacttggggcataatgtagaagtgtctggaaacattaccagaacaagcatacccatttcttgtataaaaaactgacaggtagtggggtcctggggccaagtctcttgtctggcacacaacgtggcttgcattaaaaaaagttacattgcaaggaagttgatcatccacaaataccatcggctcatcagctgtggtggctaacctctgacccctaatcagcacagtggtcagagacccactggtgtttgtggacaaggcatccatgacaggacttgcctcttcccttatgaaaagagtgcaattcccctgacactcgctggttagcccattgaccaggactgtgacgttcagggagaaggaagctccaggcaaggggtcaccctccaggctaacctggcagagaatggtgtggtctcccaaactcaaaatcacacaagtaaaaggacccgagaggtcaacccgaactgacctccttctagagttaagaagcaaccccctcacagtaagtatggtcccaccacatgccgaaccctgcgatgggaagatggccattatccgaggcatcactgcaaattgctggagcaccacagacatattagcaaatcccatctgcttctgacgtacttggagaggatagatgccagcctccagactgtgaagagggatggagcatccagacaggctcacgttgccctggaaggactgtgtctcaacatcacagttcaggttccccagaaggatgactgagttggagaggttacttcctcccacatgcaggctcaggctgctatttgtgatttctccttgcatggcagtgactactggtgttgctgccgcttcatacatgaaggtgaagcctttccccaccaagcttggtgaaggaccacgggcgaagaacctgttgccagcccagacctccacggcagctggaacagtgggagcgcccgcatcgggtatctggggggctggcagggtttcacaccagatgctcgcctccgttaagttcacaatgtcacaggaccgattgcccacaagtacccaaaccaaagctgggtccctgctgaagcctattcctgagatgctgaggatggtccctcctaaagtatgaatacggaaagcaaaatattatagctgatattctgaactaagaattcatagcacctgtggaagtcctaggtcaattaagtggaaggtagggcatgtgttagtgaaacctcaattattttttctcacccccaccaaagctaaatttgtgattatttagacaggagtcagatgtggtaaattcacataacagtaaaataatacaaattgttatataggaaggacgtcttcaacacaaacttttcaagtacctttgtatatcccagaagccaccactttaatcaacttacacactaatgaaaaatcaaatttcttagtcttcttatcatgtattatattattggaaatattatcctgtatgctatatatagactatttgtacattgtcctgtatacattcaacttatatgctaatgaaaaatcaaattcattgaagtcttctatcatttatattgttctatataatattccaatattccatatattatacattctaatatattctatttattgtaccatatattctatattccatatacgtgagagacattaaaagtcattgaatcttgctggtgaatttgctgctaccttcatagaatctttgccttactctccagtagagaggccaccaaagatcaaaccccatcttcaggacaggattggagcaacatgacccacagcataaccaaactgtacaacgtggcttttaagaggattttactatacccaaaaaggataatgtgctatcttacacatgatcacaactattattgacatgccactagattgttttccattctttctgaaaatagttttagagattggtctatttgtcttgttcttccatctcccatatcagcatgtgtgtttctatttctgagtctttcatctgtctctctcatggaaagtgaagacccgcagattcaatcctcccctccttgcatgcacagcatctaaatggcgaatgcaggacatgttgcccttgtttttctcatatccactctagagtgtcacccatcagacgtttcatcctcttttcattagaaaagcaggcacatctcggctgggcacggtggctcatgcctgtaatcccagcactttaggaggccgaggtgggcagatcacctgaggtaaggagttcaagaccagcctggccaacatggtgaaaccccatctctactaaaaatagaaaaattagccaggcatgatggagggcacctgtaattccagctacttaggagactgaggctggataattacttgaacccgggaggcagacattgcagtgagccaagtcagcaccattgcactccagactgggcaacaagagcgaaactccgtctcaaaaaaaaaaaaaaaaagaagaagaagaagaaggagaagaagaaaaagaaaaaaaaaagaaaagaaaagcaggcacatctccttgtcataaaaattccttaatttcctgagcaaatgaatcaccaagttttaacacccttttaaaaacacccctcagttcctggagcccgaggaaagtttctctcctgtttcccctctctctgacctcactggcaaattaatccagaaacaaaatctgaatatccagcaaatagaattgctggataattgataacagtcacataagagccactcacccagcagggacccacagcaaggctcgatgctgaaaacttctgtgaggtactggatgtggagatcaaccctacagaagataggcagatgtttaggaaataactgacagagagagataagaaagagtaagccagaagagccatatgtattttgaggagaagagcaaactgtctgtaagttctctaagatttgttccaatgttatgatgttcatgtctttaacctctaacttccaagggaaaaagaaaatacctaactcaaaattagaattacctagctgaatgctagaccatcaaacaaatccaaaattaatgcaagtggtcacctcacccttgtgagtgaatgctgaccccattgatagagacggaaattctgtggagaccagctggcagtgggggcagtgccacctccaggccccaagccgactgtgtgtgaaccggagccaaggcatcctggacgtggacttccacatccaaatccgtatagttcatcagcctcgccactccaatgaccagggtctcaccgcctgtgttgagaagaatccaatagcctctgacatgtggggtttgtgggctcaaccatctattcaattctaaaactgtctttttggattaaattcacagtcacccctatgcataatactcttaagagttacgataccaacctaaatttttcaagaaacttctaacaactatttttttttttttttgagacaggtctcattctgtcacccaggagtgctgtggtgcaatcttgtctcactgcagcctcaacctccagggctcaagcaatcctcccaactcagcctcccaagcagctgggattacaggcatgtgccaccacacccagctaatttttgtattttttgcagagacagggttttgacatgttgcccaagctggtctcaacctcttgggctcaaccaatctgcctgccttggcctcccacagggctgggattacaggggtaagccaccttgcctggcttaacaactcttttaacagagatatggtctgtaacctcaatagtataaaaagaaaaattggcaggacaattgtattcaagagacactaacttatttccatgcaaaggcaaatcaagaagtttgcagagctaacggtctttataaccagcaaagagcaccacatattggttgcttaacctccacttttctactggtagaagtctgaagctatatttgagtgtgcactgaaccttacagtaatgctgtatgtgagtttagtagctcataactgacagagtactttcacgtatgttatcccacttggtccacacactatcctgatgatttatatggggcaattaatatgactggtattttgcatttgaggaaactaagctcagcagccacagcctcatagctattaataattactaaaaaagaaaaaaaaaggtcaagacctgagcccagtcttttgtcttgcatttcagtgtccttttagtttaattagcaactctattaaaatgtgtacactatgaacactttcatgcaatttcttttaactcaaatatttattgagtaccataaggaagatgctgcaaggggcacaaaataagttaaacacagactctgccctcaaagaagcctcaacggtagtaaaataggtgacaaaattgcttcaataaaagatatactacaagagaggtggaaattaagcactgggattgctcaaatcagagcaacattatgaatatcaggaaagatggaatgggcaagatgagagttgaattggagcttgaaagataaatccaaaaagaaagtcatagagaaaagggggcttatcatttatttctagaaatttcacggttttatccaaagcctttcatagcaatttctcacttaatcacccagtggcttggagaggaaaaagagaattgggtgatgttctggaaggcacaggtagggttctgttttggggataagccaagttgatggtagtcctagggccaaagaccaagaaagccaagccagagggatgtctgcttaactcagtggacggcagtgaccgccaaagacttgtaagcaaggaaaagatatgattaaaactgttcttccagtctttaagataaattgaaaagataggggaggagaaatccaatctgcagacaattgtagtcttaatcaagtagaccaaatcaagtgggcaacagcaggagtggaaataaatgtccttacctttcctgtgtcccagtgtggccactgaaacatggcttgggctaaagcatctctagctcctttagcctgtaacatttgaggactactgcagagctggtatctatgggatgccacggccaattagatgaagaggaaaaagaggttgcttgaaagagaaaagtcaaagaagagggatgtggtgtggtgggaagactatgaatctgcattcaaatccttgatctgccattttactacctctgtgactttgggtgatttacttacggctctcaaagccttggatttttcatcaataacatggttaataaagcccatcccatgtggtttgttagatatcctgggaaagtatctggcatgatatagcacacaaaaaggccttaattaacttcattttcttcctcgttccccattctcttgaccgcatgtcttcccaatctctactgggaagtctgaagcttcagtgtagtgagttcaagggatttcagggctgatcaaagaaaaagacatgactacgaggtgacagtagcaaaaaacaagcattatttgggtggtattttgacagattcacagaggaggaggaagtctcccagcatgagaccttccagaggcaacagtattgggccaccatccagaaagggaagaaggcaagggaactgggagggggtgggaagatgagagaggggggttctgtgtccagatgatgtcactcagcagcctggtgggtagcctctgggacagagagctccaaaggcatcagcggcttagggtattttatagccccagggttttcttacctacagctgactgatgggtgcagtttcatggggcatgcaaagcaagaggaatttaaatggctaaaaatatgcttattttggctacgctgaaaacaagtggatgtgtaaaagtttgaatttagcactggcaggcttttgagctaatggatcctggggtgccatgaagaagtaaaaaaaaaataggaccaataggcagggcctttctttggcttgtttataaagcattcaatatctggcagaatgatggcattcacttcaacaaagatttattggtgcttactctatgtcaattcctggaccaggtactttcatctgctttatttcctattttcatgattaccttgaaagaattattcccacctatcaaatgaaggaactgaagataaaagaagttaaatatcttacccaaggagtatggtaagttcaactaagtttggcctaaggctgtctctgtaccttgagtctctacataaagaactgcaacccaactttgtgataaactgaaagcctcaactacctgagcctcagttaatcacaggctgccaactgatcagaccatgctccaataaggcaaacagggagctgtttctggcctcacttccattttctgtctataaatgctgcctgcccatgtggcatagtggagctctctgaaccttttctggttctacaagttactatgattctttgttcaaacaaactctgttaaatttaatttcttgaaagttcttctttttaacaagtggttgagctgggattcatgcagattccatttttcctgactgcagaaaccaacactaatggtcctgcacatcaaattcaccagcactccccatccttggtccctcttatgcttttattttcatttcatctcagcctcacggtcatcatcaacatcatctcttggatggagatgtgcagcactccaacttaaaagaggcattcccaaaaggctacgacacttcgtggattttataacatgctcctttttattctgcttgtagaaagatttaaatacaagtataaattttgaaaagaatgcattgcattgtatgtatcaacaacataacttttggagcacttggtcaactgtcaagctaatcctagatgcttccttggcactgatataatgtatttattcttttcattacagataagaaattttattaaaagccaaaatcactgaaatctgaatataacatggagctccccctcccttttctacctcatcaggaagaatctgtaccactaaggaattttacacacttcagtcacctggggcagcaaattcttcttctgcattatctgagctgaataatattggaagctaaaggacacttctctttatttatgtactcttgagctatggaaaatgaaaatagtgccagaaaaattgagttcagactttttctttgggaaatatgatggtctttttacaataaacccttagatatggctaccacaaaccctgttatctggcattcagttcaccagaaagggaagttacctgctactcttccaaatctatatggaattacatgataataaattattataattctaccttgccatatcctctgaatcatcaaagaaaaattctttcatgtagttggtgctaatgaatccattatttttatacgtagaatgtctcaagaaacaagaattctaagttaatcagagcatcctattctctaatcatattaaataactgctacaatagaacctgctgtcaaaaagcagtattttacagttaactacaagtagataagtacttggtatatacaaacagatgacctgtgttcaaatcttagataaattacttattctctccattccttaatttcctgatctgtaaattgaagctaataatcctataaattaggggcaaggattaaattacatctattttatgtttatgctatcattattgacacttactaaatgctcaaggaacatattttgaattgtaacttttgaattcccacatccttttcatgatggaaatggtcccatctgtacaatggttccattttacagatggaaaagtagatatcaggagattgattcgatgatggctaagatgaaaaaagcaatctcctagctttcaagaaaaaacttaaatccaaaatacaataaatttcagaggacattgattgccctttttataggaccaatgctctaagaagaaaaagatcttgcagtatcacatattttacctgctatattgcttatgtttctgctcagagtcacaataactggatttaaggaagagacatatgtaaatgctctgggaagaactgcagaatagtcccctctgatcacagtcacattcacaatgcgtccatctttcccctgaaaaatcaattttaaaaattaaacctcagttttattttaaagtaggactgacttaagggaagagaactccatatagaattagttttaaaagttaattttaagaaagttgttcctaaagggtatatttcctacttccaagtctctctcttctctacaaccctgcacactctccccatcctgcccccacacccacaacacagagtgataagtgcttggactagtaggcaagtgcagtgttagatgcataatgacatgctgtaaggggtaaataagaattatttgcaattaacacaccaattgtttctgcaaaaatatggcaatttcaaataaatgtctatacctagctaaactatccatcaagtatgagagtactttcagacatgtgagaactcagaaaatttctctatgacacactctttcataggatgtacttatggttattatctcataaaataaataataatttaaatatatatatatatctgaaacccaagaaacagtgactactcaagaaagcaatcaaagtaagtactaggataaaatctgtagaataaacctagaaaataagcaggctagattgaaacaggagaacagagatagcttcaaggaaaatgaatgactgatacgatggaactttttttaaaagatattggatttaacttataagaaagacatgttagccaggcacagtggctcacacctgtaatcccagcattttgggaggccgaggcgggtggatcacctgagatcaggaatttgagaccaacctgaccaacatggagaaaccccacctctactaaaatacaaaaaattagctgggcatggtggtgcatgcctgtaattcaagctactcaggaagctgaggcaggagaatcacttgaacccgggaggtggaggttgcagtgagccgtgattgtaccactccagcctgggcaacaaaagcgaaactctgtctcaaacaaacgaacaaacaaaagacatgtttagaaaataaaataggaactctaggggaaaaaaaaaaaaaagaactataaaagaaaaaaatatactacccggttctgccagcatcatctaaatagttagaataatataaacaggttttattaatttaagataaaaatggtattgtaactatatttgaaagaattaaaagttgtttcaggaagggggacttgaagaagggggaggaggggcaggaaaacataatttactattttccttttaacctatgcatctatcacttggatcaaaagtaaaatttattttttattaatgtttatgttctctggtaaaagaaattaagaggtacatgtcttacccattaaaatggcaaatatatattaaaataataaagtgataacccagtattggccaaagtgtcaaaaatcacacacgtgcacaatgatggtgggagtataatttgaaagggaatttcagacaactggatactacatatcaaaagctttagaatttatattaatttatcctgagaaaagaaatgtacccccaaaacatagttattaggatgattaaagccctgttgtttacaataagaaacatttagaaattatctaagtgtctggtaataaggaatagttaaacaaattagagtacaaccacatattggaattgaatgtagtgtacatataaaagctagcttttcataatatttaaggaactagatgagattaaaatgtaggactagtgatcaaagaatattttgaaacttatctcccaggggatctttattttggggtcatgggtgtgctaggaatgttgatgctgcttaagtcaactctaaatagaaagttcagtggcagcagtgcgtgtgactctccccaacagtaccagggaaggacccagactcaaatcccttaataggccatgatatagcactaattgaaaggaaaggaagaggtcagggacttgtttttaaggggaaaaggaagcaatggagaataactaagaagatatttcttagaaatcacacactctagaagtttctaagttctacaattaatacccatactagaaaacaaaattgctgatgaaaactaagttatttgttgtttgcttaatagagaagggagactttgaaatatataagccttgcaagccaacacccagaatgtgcactagctaaatttatttgttacgtgtcactaatacttactgacagtacagaccagaactgcctggttgtcttctttttaagaaattaattgatgttaattacaagctccattggtggggtcagtttcccacttcatagcaaaacagacaatataactactacaagcatactatcataatgagaagtttacatcagttcatttagttctaagaagtgattcactgaaaatgttatattaacagtggtcactcacccagagagaaagagatatgaaaggaatccacttaccctgggtggaactttgcactgaattctgcttgaattgcttgtagcgacattgatggcacacgagtaagatccaaataatatcaggctaacaccttccaaactagagcctcggatggtggcccagagccctcctgtaacaaaaacagcatattcaaatgggatcaccaaccatacaggcagacaaaaattaattatgcacaagatggataaaatgaaattaaaatatgaaactccttagtcaaaacaaaggcaatgctcaaactgcaggaaaaaaactggagttaaatatataaactatcatatagaaagggagaagtagtgacaggagggcagagagaggtagcactgcatcctgaagtcttttaagaataaaacctaggaacacaatcgtgccacaagtctgaagaggtagtctctgaaaactcttcctggcctagattttgaatatcattcctgcaatcctataaaacatattcttttcctaagaaaccaagtgcaacagagcatcatggtggaaggaacagtggctgagagtcagggtcagggccacagattgctcagctacttttagcaggtcattgcagtatggtccctgagctgaagggtcaacattttcctcatctttaaataataatgttagcccttccagctttgtggtttgacactacacatactaggttcagttcactgtgaaaatatagaaatgagtggcatcactgcccatcgccatcagaatttctctactgatcactaaagagcaaccacagaaatccccatttcttccctgcagatgttagcaagaagagagttggctccagttctgctatcatggcacacgtttccatgtggaggagcagcctttgatctagctaatgtataatgattctggtctgccatctcccagatacaagagaggcagtgaggccaccaaacagccttacccccccttgagggtggggagggatgcagaagcaagactactttcaagcatgttggggacagaaaggggaatctacaaaatctgatgaaaacctttgaggacagtgtgactcggtggactagtaccctgaagttaagtgcataactaagagcaatatacaatcgtgatataaaatatacaatatctggaagcaaacttcaaaacaaaaattaagaagataaaaaaattgaaaaaatatttgaaatactcttgaagaacttaatggatggattaaaacttacataagaaaactaaaataaatggatcgaaagagtgaacaccataaaggtgacatatctttataaattaaagcataaatgcaatttcaatagacatataaacagaatttgtacttaaattagacaagctgattcttaagtttaatgaaaaataaacaagaatagccagaaaacaaaatttcaaaaagaagtgtaaagaggtcttctgccatatcttatacagtaactatggtatcaactatgtggtaaaataaaatatagtccagaagaaatgcagatcagtatgaggctatagattaggatataagtgacatttcacataagtgcaaaataaattattcagtaaataaaataagtaaatatcactgaaaaaaaactaaatttgaatttctaccttatatgcttcaccaaaataaattcccaatttatcaaatatttaaatattaaaaagaaagttttttgactagaaggaaacatggcagaatttttattttcatataatttcagagttgcaaagtctatcctaagtattttagaagtcctgaagccataaaaggaagatatattttattatgtaaaaattaaaaatatttacgaatttccaaaataaaaaacaaagagacaaatgataataaagggcaaatatccttaatacataaaatgctctttaaaatcagtaagaaagaacaataaccccattagaaaaaatgggctaaggagataaacagacatttcactgaaaaggaaacacaatgcccctaaacacatgaaaagatattcaatttctctctcaataaaataaacacaaattaaaaccacaatgaaatattcttcttctcctataaaataggtaagtgtcaaaagggttgggaacacaccgtgttagtaaaatgtggtaaataaacactcatatatgcattgttgcttaggcaataaattatgcaacctctaaagagaatcttttgatatttatcaaaatttttaatgcaaataacctcttgacccagcaattcaacttctaggaaattatgctactaatatttttgcacatgtacaaaatgggacaactccatatacaaaataacaaagttggaccctgtttagggctgaattatgtctcccacatccccaccaaaatttaggttattaccctagatcccaataactccaaatgtgaccttattcagaaatgggatcttagcagatgtaattaaactaagatgaggtcacactaaaaaaaagataagccctaatccaatatgactggtgtctttataaaaaggggaatttgggccaggcgcagtggctcacgcctgtaatctcaacactttgggaggccgaggcaggcagatcacaaggtcaggagttcgagaccagcctggccagcatggtgaaaccctgtctctactaaaattacaaaaaattagctgggcatggtggcttgtacctgtagtcccagctactcaggaggcaggagaattgcttgaatctggcaggcaaaggttgcagtgagctgagatcgcaccactgcactccagcctgggcaacagaatgagactcggtctcaaaaaaaaaaaaaaaagttggcaggggtgtgcaagggggaaatttggacacaagcaagacacagggaggataccatatgaaggtgaaggcagagattggggtggtgttctaccagccaaggaacaccaaagattgcctataagacaccagatgttaagagacagacatggaacagagtcttcctcaaagtttggttcagaaggaaccaacactcctgacaccttcatctcagacttctggcccccagaattatgggacaataaatttttgttgtttaaaacactcagtttgtggtacctgattgcagcagccctaacaaactaatacagacccctacctcataccatgtacaaaaattaactcagaatgaatcaggtacctacatctaagagccaaaactataaaaccctcagaggaaaacataggcataaatctttgtaacattggattaggcaatagtttcttagatgtgacaccaaaagcacaagcaataacaataaatataaactggacttcaacaaaattaaaaatttgtgtgcttcaaataacactatttttaaaaagtgaaaaggcaactcacacaatgggagaaaatatttgcaaattatttatctgataagtgattagtacccaaaatactttaagaacttacacctcaacaataaaatgacaaataactcaatttaaaaattggcaagatttgaataagcatttctacaaagatgtataaatggccaataagcacatgaaaagatattcaacatttttagtcattaggaaaatcaaaatcacaatgaggtatcatctcatgcccattaagatggctactgtgaaaaataataataacaagcactggtgagggtgtggagatattgtgatatggtttggctctgcgtcctcacccaaatatatcaaattgtaattcccaatgttggggaaggatcctggtgggagatgattgcatcatgggggcagatttcccccttgctgttcttgtgatagtgagtgaattctcagaaaacctggttgtttaaaagtgcatagcgtacccctctttgctctctctctcctgtcactatgtgaagatgtgcttgcttccccttcaccttctgccatgactgtaagtttcctgaggaatccccagtcaagcctcctgtatagcctgctgaactgtgagtcaattacacctcttttctttataaactttccggtctcaggtagttctttatagcagtgtaagaatggactaacacacattggaaccctcttatattgctagtaggaatgtaaaattatgcagccattttggaaacagtttggcaatccttcaagaagttaaacatggagttaccatatgacccagcaattccatttttaggtatatacccaaaagaactgaaagcatatattcctgcaaatcattgtacacaaatattcatagcagccttattcataataatcaaaaagtggaaacaatccaaatgcacatgatgagatggatggaaaacaaaatatggtatatccataccatgtaatattgtttagtcataaaattgaataaagtactgatacatgttacaacatacatgaaccttaaaaatatcatgccaagtagagaagccagatgtaaaaggtcacatgttgcattattttatttatattagatgtctaaaataggcaaattcacttagacagaaaatatatctgtggttaccagggattgggaagagggagaaacagtgactgactactaatgtatacaggttcctttccatgatgatgaaaatgttgttgaatcaggtggtgatgaggtatacaactttgtgaatatactgaagactgctaagtttatactttttaaaaatgagttttatgatatgggaattatatctcaattttttaagttaaaaaagagatccttggggtaaagaaaagaataaaatatcctacctatttctaaggtatactaccctaggccaagccaacattatctctcccctggatgtctgtcatatcctcctaaccggtcttgctggttccatctttgcctccctactgtgagttctcacacagcagcctaagtcagatcatgtcacttcacttgaaatcctccaatggccaccatctcactcagaataaaagctgagtgagctgagggccattcatatcccccaaggccatataacttgctttgggtcatcttctactgctctcccctcactcaatctactccagccatggcaacctccatgacattctggaacaagccagtctaactttgactcaagactttttgttccttgatgttccttctgacttgaactgtcttccccaagatttccccagaattcattccttcacttcacccatatctcccttctctaaggccactcatgtcattcctccaatgccaatgactataccatcacaaccatctactccatccctcttcatccccttcccttcttgatttttatcctatacacttaccatcactgccccaagaacagaggatttgtttttatttactgtatccccagcattaataatgcctggtaataaaagctaaataaattgtcattatgattattgttgatggtaacaattaaaggttgaagaggtgatgatatcttgccattctcatttgaaagtttagactatggccacacaagagtccgtaccttaaagaagacaatgctatctcagcacaaaaatgaatgaagaaagtatgtaaagcaaagccaagattttcctcaaaaaaatcctttcaagggttttgcttctgcaaatgggtaggtggtgatttatcacattattgtatccattcattacatatgcaaatattctgtaaatttcttgctgataggccccagcctggttctctttaaataccccagagcatcatttctcaaactgtactcttcatagagattgcctgaggacatgttaaaatgcagattaattcagaaggtctggggtggagcctgagactctgcatctctaacaagctcatgggtattacagatactgcttgtccaggaccacactttaaggaccaaggtcttcagcacctcacacagggctaaatgggatgggccaatcagtgttgagtgagtgagtactgattaactcataggtggcagggcaaaggaagaattaatagaaaaagtttaaatccagtaataaggaaagcagcagctagagcctctctctctccctctccctttccccatagtcttaataaaagataatttctacccgcttggcatatcccttctcagagttttccatcttttgctaaaataatgtacaatcctcctagaaatcccttcactgaacagcatgttctgatagggtaaccaactcactccaattttcctaggaccaagttttagcactaagagttctgcattccagttttaaaactgagtcttgtgtcctgggaaccccctcagtcccaagcaaactgggaaagttggccaacctacctgtgcaaagcactttgtctaggggaaacaaaaatgactgagtcacctgtttgccttaaggtggagggagctgaagaaggtatgtgtggcctgaacagcaaaggtaactttgaaagaagatcaaagccccttataactctatagagaaaactacactatgccctacactcaaaccaataattactgggttaatacagaatatgatctttcactctgagctccatatatcatctgaccttccttaaatcatggagaaataagtgcaagttatgcttgctttgttttatgtgcagaaacaaggtggggtgggcctcataattcactcttctaggcaaaatagggtcagaaaaaaatctgttcttttgaacaatgagtttgtggccaaaccacactgcttttaaatatgttctaagctgcagtcctctggactccagaataaaccatgacaaaaatccaaagcattaaggaaaagggctttatgctctaatgtttattcgttaacaaacataagcatcagtattcctgagattcttgcaatctggctgggttgtttttaactggctgtgtccctcagaaagcagaaagtcatggagaaatatttgattttccatagaactaacccaattcataaggctatgttgacaagacccaccaccctctgtattgcccactactcaaatggcaatcagttttccatgctagccaagtatcccagtgtgcatcagttcacaaacttatgaaatatcaaacatgtatgaaagttatgtaggacccaattatgcctgacaccaccagccaaactataatcctttatgtggcaagtgagttcatttaagggctcaaatgtttgttgctcatttaaatacttatgtcagtaaacaaaagacagtgagtcacagtgaatatggaattcattacacagaaggactagattcctatcagcaagaacactagcttcagagggtcagacatactgtgagaccctccccagattaccaatatccgcagctctggaaggctccaccatatccagtctaggtttcacatttaggaagaggtcttctccagtggcactgatggcaagaccagagggtctcaccaacatcaagatccgatgcattccaacaggtagcaaatctgtctgacagactacattggtctggtttgagaaaataactttgcaactcgttttgttcactgtaacctgcaagaactgggagtcaccagagaaaccagttccggtaatgtaaatcattaggttgatgtcaccatcttaaaggagaaaagaaattaaaaaacaaataaaataatctctcagtgatattacttcatttgagagacctctcactatcatcaaatgttccttctctgcccccatcccctcccaaaattcaaggagctgaatgctgaattaaatattggccatctgtatttgttattgtagtacacagccccgatcttaaattttctctaactagtgagaagtgatcactgctcaattttttaaaagaacataatatttcaaaataaaggacaaagacaataaaacatttttagtcatcaaaagtccatctctccccatttcaaatcatgaccatatcccttagatggaccaaaaaatacactttctgctacgtcactcaacctctgcctaatgaactaatttatcttctacccacccatcaccagctacatggcctctaacaaaatcactgcaagtctccggcttaagcccatctcagagccaagtgacaaatcataccaatggagtaccacacagaatggacacagggagttgacccttggaggtactggaaagagcaggaacctgggcaatgagctggtacatcattcactcgcacaaccacctgaaatgaggcaaaatttcttttccattttatgcatttcatatctaccagggtattcataaagtatatgtgaagtgctcccaagctgacacgtgttcatgattcgctaattcttattccttttttctatttttccagtaattaatcttaaattgcaatgaatggctcaaaacacatgaagctttcttaaaatgatggtggacatgctgaaccccatttctgtaattaaatgtgataaatattgagtaaatttatctctgtcatatagaagtaaacttcataaacttaaactgcataaggacttcttatcactctgtatttccaaccaggtacctactttatgtgacaagctctttatttgctagtaaagaccaacaaatttggtgcattccttccaccactctgtgaatatataactaaagactagagtgtatttggacactttacttggggtctcttttgtcacagaatggtagattcctaaagagagactatatatctttccctttcactggaactaatgttaatctaatagaactcaaaaactacttggaaatgagaaaggtaaaaaagatgtgaccccactgattctctatgtataaaaaatgcattaatagcatacagattatattcatgacagtgtttccttattaaaggaagaggtattgcaatggcatggacaataaagaacacttcaattttatctgtactgtttcattttttccataaagacaaaaaatataaatatatcagaatgttgacaatgtcaattttcagtttgggtccccaggtgttgataatattattctttattgtttttgtattttaaaactttatcaaattgaaagtagatgacctataacagaaatatggaaagataggaaaaaaataaaaggactttttaaagacaaaaagaatgacttagctcatttactttttgataccaccaggtagaagcataaatcatatttagctatagaaattatcaattttttgtaccataacaacagtatcaataattataatagaatattgtggttacaaggcatttatattttcagggaactgtacataccctgtggaggtagaaaaaggacagccataagtacccctgttttacacattggcaaaatgacccttaagagctaaatcaatgagtccatgttacaaatcagtgaggagtgagttagacttgaaactggagcttgcacttagggtggcccattcactctcacctgagtatgctggttggcagtagccaacatgtctccaaatatgggtccaagaaaaactccaccatcatataccacacgcgtggctgcagcaggattcactccagtaaggttttcatcagagacctgagatggttacatttctggtaaattctgtcatggaaccgaaatctaatctcgtctaatcaaataataaagagttttttcacattgtgtttcagataatcagacagctagaaagtgaaagcagagtaacagagaattgaaatatagaaacgtaacagtaaataatggctgaggaaagtcccagtagattagagaaatattcatttgcaagtggattgccaaaagaggtacaataaatcaatcttctctctaagtcttgagacactttgcttctccatgcttttccattttatatgtttgcaatccaaaatattaaaataaagtggaaagaaacagtgccatgagataagagcaaggtctcccattcttcctccatctcctttctagaatttcgattgaaaaccagataacccacaacaccatacaactaggaaaaattttcatcttgggcttcattttataataaccaaatgctagttgatcattagattattttttaagaccctaaatatgcaagagcatctggttttgtcattacccaaagacagcaaattcttttctaaaattccttctgctatgccatctgcttccacaatcatctaagtcaatcacatctgcttaaattatccaataacagatgtagaattattgcatggtggacactgaccaataacttcactacctacactgagttaggaagggagatgttgggtttaaattgctttttcagggatatgatatacaaaatatgtgttgaaaacttccagaaagaaagttcatagaatccctttactcaaatattccaacaaaattaataattcatgacagtttccatttgtataattctgatttttttttttgcagaatttctccagggcagcaaatccatgccactagaagggatactatacataccctgataaaattgggcaaatccccaatctgagtggaccaggacaaggtccacacgtgttcgtagcaagtgtatagatcctccttcacagtgaagtcactggcattgaggtacctggatgtgaagtcatcggcattattctgtaagagctggtgaaggtgatgagcagaaatttgtacagggacatctgtgagagaaggttttgatacagaaaacacagacactaattaatccaccttacagagtttcatcctcaaggataacacgatacatactaggatgcctatcaaattttcaggagacccttctgtcaaagtagaacttcagtagaatccccagccataattaaaccattttttcctaaggtaaagacaagtagatgcccactttttatattacactatctttcactcataccatatcacacagcaatcagagagcacagccatgtcagataaaaccatctcaactgtcaactcaaaatgtaaactccacacacccttgtaatgcctgaaagcataattaaatattagatcttccctggaaaaatttagctggccctgtgaacagagaaaaattggccacttttcacagggagtgagggaggcgtacagcagctgacacccataaaaacttggccagcccagctgaggaatgttggcatttaacttcagtttctctattagaattttctttaagcccaaccacctgcttccccattccatgtccccacagaagaataacagctctctgtatttgaaccctgctttgtgctctaccagaagttcccatttcattagctgctcccagcagccctgtgaggtgggtcattgggtatcctaatgtctactttagggatgaagaaaatgaaacccaaccatatgcagaagcttgccaatgcagaaagacaggtttacatgaaaacacaggttgccttctacctactcaagagcatttctcttgaattccacgctgccctgaagggctaataaaatatcactgcgtttctaaattgcaaacgaaattgttatccttttacaaatcatgtttctacatttatacagagtttcagatccatcatcattcaaaaggccaggccaaggctgactttcccagttgttttgcaggcggtgatctgaggatcatcagtgatagaaatcagtagcaggaagtctctacggatgagctgtcttccatgagaagtaaaatcaaatataaatagcacagtaatgagcctcatagaggcagggcacgattgatgttttttcccccatttaccagaatcaacacctagggatcttcgacttctcctgagtcaccctattataataaaaataccactctgttcctctcacccaagaaggtcctgtgcaggcctagggactttctgcttgggagggcaaaagacttttggaccatgttccaacttttatacagcccctctcaagttctactgagccttgcttctgattccccatgtttctaccaaataagtaacgtatcattatcacttctaatctttgttctttgtgcattgtatgtattcttgaagatttacaaacactactctaattgcatctgaaagttctttctacatttgttgggaccactgaaatcctccatagtacatggtgtcaccattaagtctaactctgacggaccatggctaccatgtatcttggtctataaaactctagaaagaagaggactgacccaggaatcaaatacctgggttcacaactggaccctgtcatcagctatttgtatgaccttttggcaagcttcagtgtagttggctgaacggtgaaccccctaaaagatggcctaatggcctaatccccagaaaatatgaatgttaacttataaagcaaaataataaactgcatatggcaaaagatgtggctaagggtcttgagaggaaaaatctgtcctagattatcccaggtggaccctaaatacaattatataataggtacccttataagagagaggcagagaaaattttgagatagaagaggaagaagcaacgtgaccacagaggcggtggttggagtgatatggccacagccaagacatgctagccaccaccagaagccagaagaggcaggagcaaatacttcacaggagtgtggccctgccgacaacttgattttggacttctggccccagaactgggggagaatcattttttgctgtttgaagccaccaagtttgtggttaactccttacaacagtcccaggaagctgatccactcagtttccacaactatacatcttccgcatctacaaaatgtaaaggttggggtagcattaacaataagtccctttccaaatctttcactttaagaatgtcactttcagacactggaaaataaataaaatagctttaatattatcacctgtctgacaacctcccaggatgttgttcccttgggaatgtgagtgagaatatgtgagtgagaattgttgcaaccccaatcacccctttaccagaaatcactgtattaggaagctggatgcgaaagtgtcctcctagaggtggacttgtccgctgtcgtctctgtgtcgtcaccaggaccagtccagatccctcttctgttccttcagtgggcacagagctgtggcacgtcagaaacaaagtattaacgtctgggttggggtgtgcacctaggaggaccttgtctgaaggatgtcctgtcttgcttaggctgcagccttccagaaagagctaagggacctgaggaaactcagtaagggagttttcaggaccactcgatgtgagaatcatttcagagtaacttaattcgtgtctatcatttcagagctaaaaacgttggcatttagagcctaccgatatggtgggcttcctctctgccactgaagatgtctcacctcttcattttcaatggatggttttattgcttttcctgcccagaggaccatggaacaaacatttagtcaaggaaagtaaagcacgggttcaaactttctgcacctgcctttaatatgccattgcagcatgctgtaggtacgagaactcattttggaacatatgagaaaaagatgagagaaagaaacctatacagttatgcatcacttaacagtgaggatacattttaagaaatgcatccttagacagtctcatcattgtgcaaccatcatgcagtttacttacacaaacctagatggtacagcctaccacacacctaggctatatggtatagcctgttgctcctaggctacaagcctgctgctgtactgaatactgtaggcaattgtaacacaatgctacatatttgtgtatccaaacatatctaaacatacaaaagctacagtaaaaatatggtagtataatcttataggaccaccatcatatatttggtccatcaccgacagatacattgttatgtggtgcatgactgtatatttagacatatatgtgtatacacatatatacactgtgaatatatatatccctacacccacatatacatatacatacatcaaaggcagagcactcaattcttcccattctactggggtttaggtgaaaaattaaaagaacaaattagagtatacatgtgttccagaagcttagaagaagcctgatccttagttactgctttgtaaactgtggctagaaatggttattatgaagcaatgcttatggggctttagtgccatctggtggtgagttcttagaaatagctatttttcttctctagacatttcatttcaaaggatttcaacaagattaacacatgaggaatgcaatgaaaagaacaacaacaaaacaaaacagtggtgatgtgaacctctgaacagcacaaaatgccactatttttaaactaactgactcggaattagttctcaaagcgtagtccccagaccagcagaatcagcatcaccaaggaacttattaaaaatgcaaattgtcaggtttttccccaaacctactgccttagaaactctgacagtaggcccagtaattttaacaatacttccaggtgaatctggtgctgcattctcaagattgagaacattgctttaagcaacaagacaggtagcttttcctgaaaaaagtcacacctgtgtccctcaaggccaacaagcattcttaggagaagggacaggtgtaaaaaagccactccttaccgtgcagtgatgagcgggagctccgtgccacaccccgccagccaggaggtgacactgtagaccggaggggatcccaccacagagactgattccaccagattgccccctgggcgagccgttccagaatcagcttgagaaactagagaccagtgatccaattactatcaagtgacttaagatggtagacttgctgtgtggaaaatcccagttggaaatgtgagttactcagatctcagtacacacctaaagcatagattcctacttatctgctgccataaagaacacatggagaggacgcaggaggataagccattcagtttagtacaaaaaggaaagtgcaaggtcctgatttaaggagatgaagattgattccatagaaaagttcaataaccccacagctagtaaaatgtcactccctatgctcttggaggcactcctacacagttaatctattgcagtatagcctgccaccctttcctcctttccttcccacagcccctggcaactctagggatgtttagctgatcctcttaggagcactgaactcagaggcatacacaggggcacttgggtgtttatccacagtgtggagccagcatgtgtgcagaaagggtgcaagctttaagagagaccactggtcaaatcctgattttttcacttctattggattcccactcagctaatccacacacactccataagactcagttttcttatgtgtaaagcggggattatgacatgcatgattgatagcaatcaatctgacaaggagagcttagtgagatttaagatttaaaatgatcagcacaatatcaacatccttttagcttcttccccaagattggttacaatggagactttaaagagtttaagggcaacacctttgtctaattcgtcttctcatgcttgatgcttagcacatgctaggcatagactaggtggtcaataaatgattacttgctcagctgggtagatcagttcgagggtcagtgatcattagattccgatctcctccacagctccgctgtgtgaattggggcaaaatactccactccttttagccttggtttccccacccataggtggggataacaggaccaactcatgggcttctgagaactaaacgagaaataaatggaagctaccactatccagtggtagtgggagatacaaagaagtttcatagaggacattagtcaggggaatatcatcaagtataaaattgagatcagataaatgatatacaattaactatgaatattgagcccaattgtgtagtttatgttgccattaaataattctgaaaacaaagccattgccagcagggttaatgtgataaagtgggaggcagaccgtttcatgtatgctacccccatcttccctcttgtctccgccctctcccttcctgctcccacctcacctcacccctggatgattccagatacacagagaatttggtggcaaagaggtgagggcagtaagaaaaagttctgaatccttggcttcaagtgtttggcgaggcagaatggcattaaagggagagaaaagaaaactgaacagcacctattatccagtcctgagttttccaactagtggactccagtgtatgaaatattgattccctcagccttctggaaattgaggcagcacttggggtcaccaaagacccccagccagttgtcttgggcaccaaaaaattcaggcagtcacccagcacgtcacttgagtagtgtcattttctaagtgtgccagagcacaaacaggtttggaacaataagcaatgacccagatgtccccaaaacacttaaactatggaaacagaggagagatgggattttgatgagaatcaaagatgatgtaatttcaaggctgataaagagtcctcttgccacccatccccaagttcccctgccttcagtactgcaatgtttaggcaaaagactgaaaagttgtacattttctaaatcaaaatgtaaattaaggtatcatctttttcttcttggagagggaaataaactataaaaagtaggctagctgagccccaaagccacaagggatttgacagagaaggaaacatgagcaaaagttggaagcctgaagacactgagggcaaactgcaccattctgccttggctgtgggcgcacatcacacacagacacctcagcagggcccaggaggaggactttgtccctaagactagcgggcaagagccaggtgagaccactgtgcccaagagtggtcaagggagagttcgggaaggaagagccgggcctgatctctaaataatgagtaggaagagtctggagagacagaaaggacaagggccttctctctgaagaagatgattaccttctaactctcactgcgtctgtcttgaaggttgtaaatcagactcttggcccatttacagagacagacactgctgagttccttccagcacctggtatgacatattaactcatggaaaggtggagaaatcctgctagtctaatgataacaataataataacaataattgcttatatttattagacaccttctatggacaagaccagtaaggagtactttatattaaactttagttaatcttcaccgtaatctaatgaagtagggtccttattatacccattttacagatgaagaaaccaagacttcccagcaagaaagtgggaaaactggagtaagaatacagacaccagaagtaagagaaaatcgtggggaaaataggaaagaagagggactagagagacatagtaccaaagacacataatcccagccccatctgttttctagagccaaggcaggcaaaaaggaggatcacctgttctctcctcattaaaaaaaacagtaacccctagcaggaaagtttgaggtaggcatgtgaccggcttgtggaggagagagaatttgatgattacctgttacgtttgtgtctgcaataataatttcatccacatagaacaggcccgtctcctgggccagagggagaaggttgatctgatgaaccagcactggggagtttgccggagggggctggagatccccgaagcaacgcacacaagtctcccagaggtcagtgcaatcgaactgccagctgaaaaacagcatggagcagaactgggctctcagggagcacttgcagtcctctccggttagagcccttgttcccaacctggggggcctgtgagctatgcagccaggagagagaccccatgaacccctgcacccaagcagtcctgggtgccaaggctacaaacatcccacccaagatgggatcagctcagccttggttataatgctagtagtcaccttttaagtcaatcattcatccatgacatgcaatgtcagcagcattttcaaattacagtttaactgtgtgtcttaagcaaattataatgtgaggctgtaaccacagagaagattgatacttctggacattaccagtttcatttaggtttaagaccatttacaagacccatgagaattatgtggaaagcactgaatcaagggatcaagacagctgaattttattccagggtcactagctgaatgaattttgatgaatcacaaattcttggggccccaaatttcctctttctgtcatgtcaaagaatgttctctaaggtttcccccaactacgctgttctacaattctatccctatgagaaatgtcagactccctctagggagtagtatattcttaacaactaactgctctggagtcaaacttttttgtcaaataaaatatattcaaatccccaaattagtgtatgaggcccaaatataagaccattagtgcctgaggtgggtaactgtccccaaaacagtgaatcctcccagctgactgaattcccaccacgcctccccaccgattagctacctctcggggctggtcctcgtgagactccagtcacaggtggtattctttaccatgttttgaaagccgattgtgaaggacacaatcatcttcaggatcttgttcatgtggcctttgtatgcaagacacagctatggacaccaaataagtccttcagttctattagtgcaagaagcagtcattcaaacaatacgtagtgaggagtccacatccctagaaccctgccataggctctgagagagtcagcacagttcctgcccttccagagcttaccagtgtagccagagagacaaataacttaaattgttatttccctacctaaataaagctaaggaaaaatacaataaatactttttctgagaccaaaaaaatgtcatcaaacagagtttttaaatgcttagcactgtgcttggcagtgaggattttagagtatctcacttaagaaaacccctgttctaacccaattacccgtgcaacctcgagcaagtaactcaacctctctgagcctcagttcctcaactctaactccccagcatccttggtttctaactcagttaaaggcaaagctgttgccacaagaagactttagagcaggagttttcagcctcggcactatcaatattctaggggctggataattctttgtcataggggctgttctgtgcattataggatgttcaacagcttccctggcctccacccaccagatgccaatagcacttccccagttgcaacaacgaaaactgtctccatacattgccaactcttccctggggggcaaaatcacctccactgggcgcccctgcagaagagatgaggctgaagaagggaggagctcaagcctgaaacatttagccccaactcccacagcagcccaactaggaaaagactagaaactactgccatgagctccaccactccagcaaaactcactctggttcccaaagggcaaatcagctgcacttcttttacaagggtggtggagctatcgaagcaaaggatttaagaagtgtttgcgaaatgcatcagacaattcaatccatcaataatgacaacaactagagtaataataattagccttcactgggtcctaactgtgcaggcactttactagattatctcatttaatctataccacagtcctgagagatagaccacattactgtccattttacagatgagtaaatgaaggcatactgtacttaagacagacatggaaggtacattgggtgtggaatcaggatttaaaaccagatagtccaatgacacagtctgtactcttagagatcaaagaaaatattgtagcaaataaaaactttcacaagtctcacagctaatacaaaggcatttccaggtaacaacacacaagtgggggccagtggtgtccattcatacctgaaacagcagtcgagagacctagaacctcagcctgaaacaccttgggcagatcacagcaatcactcctttgtgcttctgagttttcagtcttgaatccagagagcaataccaatacctacccacctgacccagaagcacaaagactgctactcacgtgtgtatactgatctagccgatagcccttctgggcagccgggggagtaaggacaaggtgtcgaggctgacggaggctgaacctgccacagaagggctccgtcccactggtgaggtccccatcagagttggaaacttctgggcctggatgcagttcagataaaatagaaaggcaggcatagatattaaaaaagacagagcttccctacatgtgtgcatgaggattttagagtatctcacttaagaaaacccccgttctaacccaattacccatgcaaccttgagtaagtaactcaacctctctgagcctcagttcctcaactctaactcccccagcatccttggtttctaactcagggacaaagttgttggcacaagaagactttagagcaggagttttcaacctcagcactattaatattttaggggctggataattctttgttgtaggggctgtcctgttcaccatgatatgggcccctcagccctgggaggaatggccacagcatgagtggtcagcacccctggcttgaaagctccagctataagaaactcattctgtgttccctggagccttgaaaaccctttagcattttctctgtgtagcaggatacggaaaactattgagaagcaaaaagacaaggaatatcaagatggaagaggtgttcaaaaataactagaatttagttcgccttagtagtagttttaaaaacataccctaacattttaagaatttcttaagactactttcttaagtagtaattcctttagatgtaatctgaagattagcatggttttggctatgtttgcatgtttctcacctatgtctttgaccttttcccaccgtgtggcatggggagtataggagggtgctgcactctacctaacagcccaggaggaatgcctttcctttctattgacacccaccgagcatcaacctcccaagcacagtgcagtgccagtccctcagccactcagtgtccaaatccaggtttcatattttttttttactctgttatcaccttggagaggaaatggggattgttctcattttatagaaagaaagaagaccatgatgaaaaagacaatcagaatgaagccacggacagcacctcgttcaaatccaagccggagaaggatgttagaccaaaggggttccagtttgcattttactgcaagtaactcctcaatggttgtttgaatctattacaaaggaaaaaaatgccaggaatttatatcatgagcataaagaccacccccagttctcccactcccctccctcattttttgaagaagtctcccaccagatgggctgtggcatttgcagggattggctgactagagacattgtcccaagtaaggaagaagtttcctctgcctgatacattcagcacctaaaaaagtcaagacagacaagactaaatgatggtgctaattaagccagagagacaatctaagaacacaggacattcctcctcaacttgctatttcctttttattataattttaacttttcaatgctttaacattcagaaatctctgaggaacacagcatcattgcctaatgagaacttttgttggactaacagagatgtcagtcttcctatttatctgtgccccttgattgagagtatgagatgtaacagttgccattgaatgctgcactttcagcccctctcaccaattgctttctcccaagggtagcccagcaggcagaagcagctccatggcatgcaccctctcttggaggcttatgcagtctctgctttgcttccaacacatcaacacattccctgtagggcacattatagttttgctactgagtaagttctatgcagcttttttttttttagatggagtttcactctgtcaccaggctggaatgctgtggcgtgatgccggctcactgcaacctccgactccctggttcaagcaattctcctgcctcagcctcccaagtagctgtgattacaggcacatgccaccatgcccagctaatttttgtatttttagtagagatggggtttcatcatgttggccaggatggtctcgatcacttgaccttgtgatcagcccgccttggcctcccaaagtgctgggattacatgcgtgagccaccacacctggccagcttttaatctcttaaatcaattgttactttctactttgttctatggttatttgtgcacatgttttacttttagactgtaagctttagagggcagagttcatattgatttgtctttgtacaccaaaaagtgaacaacaaaaactataacacataaaaactcttcaaagaaaatatggggcacagctgagagacccaaaggacatgaccttttcaaagtagacttagaaaacacaggctatagggaaataggacctcaatcagtcaaaaattatggaatttaatgtgtatatgctcacatgcatgcacgcatacatgtcgggcgtgtgtttagaggaccttgtctcttttctgggaaataagtttctaaaagaagacttgcttggaacttaaattcctaaaactaactcaatgagtaagataatctcaggaataagacatcacatttttgtaaacatcttcacaatgctgttaaagagatatcctatttctttgacagcaaggttataatgacccctcaggtcgccagactcccagtcagtgctcctgctacatgggactttattccttccagagttcagctccatgggactggaaagagacacagacctgtacttctggaagcctctgggctcggactcggatctggtgcttctcccgtaggtaagtggtgaccacatcaggattcagccaggtgttgtgaatctggacaccaatcctcatccccctgcttggggctatcccatgatgctctgcttccaggtagtacatggctccacccaacagctccaacttgggagtcttctgctgccaggtcccttcatccctattctgctcccaggagtcaaaccagtcagcagtgccgacgctgatggaggccactttcacctatgcccaaataagcatatcatgatcaatactatgcagcttccaggcatctctttctcaaacactaagtgtctgaactgctactatcaagagagttttgaactggtctgcctttttaacatattaacccagttacctcagccctgtggttatttatgcttctccagctctctatctatctatctatctatctatctatctatctatctcttacaattgagtagtactcaaatgagaatagatgggccatgttcagagaaggaacaaccaacctaaaccctaggattacatgacactatggagaaggtagtattaagcccttcagagacctcgaatgacttgatcacatcaaaatctatgacatttctccaataaactagcaaatcaatttcagacatacatagtaataatttgaggaaaatattgtgattctttgtcaatagcataagtgcattttggctgctgttaaaggcatcttttcttatccttcaatgttgttgaggaattcctacatacagctgcctacatctccacccaaaattagtggaaaaggcacaagttttgtagtcaggtaaatttggggttgaatcctcaatgtgccttttgctatccaagtggattgggcacacaatctttcttttttttctttttctttttcttttttttttttttttttttttttgagacaaggtctcactctgttgcccagactggagtgcagtggcagccacgactgcccaaggctcaggtgatcctcctgcctcagcccctcaagtagttgggactataggcatgcgccaccatgcctggctaatttttgtatttttaatagagacagggttttatcatgttgcccaggctggtctcaaactcctgggctcaagtgatctgcctgcctcagcctcccaaagcactaggattacaggaatgagccaccacacctggcccacacaatctttccaagcctcaatttcttcatgtggaaaagatacatacatatatctttatgtatatatgtgtatatacacacaaacacatacataatatatatacatatatacatacatacatacattttgcagagatgcagtgaaaactagagacaaggtctataaaagatgtagcataatatttggcttacagtaaatgctcaataaatagtacgttcacattcaaacaagttctttttcaacaattaaagttcctgatcatccaatggcatgttaaactatctgtaaaacatgagagccttaactttgattctttctttcttcatgggtatgggactggcaacagagaaaaggaaaatgagaagacagtgaataccttagtccttggttcctctgaccaactgaaatgcaaggaagcttggctatctgcctgaatccagaaagtgtaattatttgtctctggagccacaaagaacccactgagccgtgctctgtaaagtagaacatagagtcaagcaagagtaaccaaggcctgaatcactgaaccaacaaatgactgcccttgtactttgtcttcttttatggtaataaagaagaacaacctgattcttatgccacacaattgtccagaatattctagaaagagatatagcacctgcctagtctcagtagcccaatacatctctacactggacacaaatacccttgctgttgtgtcatgtttgggaaagttgtagccacagcacacagctatacggaagcttagctgacaaaaccacctaacacagctattgcaagccctggatcatggtagaagctcaatctatagtaaatactattcttattattagaaataaagacagattgcttatgagaatttgctctgagcttaccagctacctcaacacctgcagagagcatttttctaattaaaaatattatgatccacagataagcgtcaattcaaaatgtcaacaatttcaaattaaaacccatcaaatgcaactttgaagaagattacaggcaatttcataaaacattttttaaaagataatatttttaatatttaaattccagcaacctaatattataggcagatatagttaaagaactgattagactctgtaaataaataccaagaatattttctgataatgctattttcttaaatcttcagatgatcaatataaagatgtttttaaattttgctttaatgtacatacattatctttatttttgagataatttcatacctaaaaatagcttcaaacataactactttaaaagtccacaatataattatattaacttaccaataaatgaatattttaattttttaatttaaaatttttagattttaaagagattaatgagagagggaatggaaaattagttactacctggcttgtggttcctcaaaatggcagttaaagggacataccctgcaacacttactatagaagtcaaaatgttcttttgccttttggggtaggctgactcactccttaacactcccaaatacaccaaatgcagctgaaagattttcctttgaacattattaaatggtcgttaaaaactatgataaatatgaattattaggtgctacaatggaccacaaattaactgccacatttttgtttatttgtttctttgtttaaagacagagtctcactctgttgcccaggctggagtgcagtggtgtgatcatggctcgctgcagccctaactcctgagctcaaacaattctccacttcagcctctcaagtagctacaggtgcacaccatcacacctggctaattttttattttttacgttttagagacagggcctagtcccaaactcctagactcaggcgatcctcctgtctcagcctcccaagtagatgggattacaggctcaagccatagcatccagccttaactgccactttaaaaccataaactcatggttaagtacctagtaagtaaggcttcaggagacactttcctgctcacagattaccaaccctacttggcttattcaatgcctaaaaattctctaagcttttctttacacaactgagttgaaatctattagattggtgcaaaagtaattgcggtttttgccattaccttcaacggtaaaaaccgcaattacttttgcaccaacctaataaaatggtaaaatatttggaggaggtcacagactgactgaaattcacactcatgagtcacagtcatcctctctaagaaggatttcaaagggaaaagagatccatcattcagtaaaggatccatccttcaacatatacactgagaacacactaaggaaacagtgtgtctaagcaattttcaagcttttatatttttaagtttactttagaatactagaaattttggctacatccttgaagggactaaaaagactaaaggaattacacaccattaaacaggaaaattagaatcatgatgccatcactactactgaaaacaatgtctcacagaacccgcaagagcttcccctactatacaagggccattgggttgaccttcagcactggaaggctgttcctacagcatgctgcctaggctttgctccctcatgtacccaaagggcaaattcttggatctttctttggcatcaaccagatgttagttttacctcttaaccaggtacctaaagcatgttttactctgctgtctttccagtctcctggcctgctcagctcaatgttctagttgataatcatctccaaaacagattgtaaactaagttgtggaaaatatacatattacatattgatcaaaatttgtccctgcactagcatgaccaacactgattgagaatactgtcaaactctgttgttgttgaattggctagtgttataaattcctggaaatcttgataccttccttatctgtctcctagcctcacctaggttagcaaaggtgcttttgatgtgggctcccacttttcctacaacatacctgaaaggttgtccttcctgtgaccaaaacccaaatggagaactggcattagggacaatctgccacctgtaccctggggtggcttcagtcagttccagtccctcaacagcatctccaacttcaaaaagaagccctcgattgcctgtaagacatgtagatcgcataaacattacagggcgcaccttcccaaattggggaattactttattttaaattacaaggtgaaagatgacccagatgctacctgtaaaggtaagtcaacctagagccagatagagtagttatatgaaaggttctgtagttaatatgaaatacaaatgttccggaaagtaataaacattccatgggttaggagttagccttttttagcaagagttcctagaaaagagaatcaagtcctggagaaaatgtgaattgaatgagcaaacagaagctgaggctgagtaaaaggaggacaatgtgactgtgtgctggtgacgtggcttggctttgtgcttcccaaagccagaagtgggcttcagtatcttttaagtcccagttctgctgtgaaattcaattctctaaagtcttttttccccataacattggcaatccttaagtttctcaagtgtcatggcctcaatttgtggacctgcacacagagccaaatatgtggcatgctgctattatgtgacattttaaatgatattgtattaatttatattttgtgttaagcaaaccctgaggccaaaggcacaggtgcaatcaatattgaatgctaacttgggctgaaggcaaaactctggaatcccagctagacgtgtagctttgagcaaattccttgatgtccttgcatcttcattttctcatgcatcaaaatgggaccaataataaaatagcaataatacactaggaccaagggaaaatatatactcaaagagcctggaatacagtaagtgctcaataaaggtaattatggtaattattattttaaactaatactgttgttcctcaacaactcctaaaagggagaggtggataaggaataaacagaaaagtaagagcatattttgaaaatattactttaaaccagggtttctccaccccagcactattgatattttaggctgggtaactgttgtgagggggtgtcctatgcattgcacaatgtctagcagccttcccagcctcagcccactagatgtcagtatcatcaccaccaccaccacttccggtctaacagccaaacatgtttctacacattgctacgtgtcccccgaggggcaacattgcccctggttgagaacaattggtttccatagtaattcgcccagcttctgtggaagaaacttcaaaagcccttcataaaggacaacactaactgtcaaaccagctgcattcaggaaattatcctaccactacccaagtagctaaagcaggaaatactgaaaaagggagcagactctctatttcctgacaggaaacacacattatcttgattacttgtttcagtagttttgtttccttggatggaagctttccctgagtaaaaactgcagatctgggagctggagaattctcaagccaaaactttgcatgcattttcacacctgaatgccctttctttagaaaggtttcttcccctgctgggcaactttccttgtaggtgctgtgcctctagagttgactctcgctgcctgtagtttaaccattaagtcaggcccttgggcacagatgtgcagcctgtggttcttggctgagtaacataccaactgcccttcatccctgactacacttgagccttcagttctaatgctcagcagaaaagtgctccagtattgtgctcttaatttgctgctgtagggtggatgctttaaacagagaaggacagctggaagctcccttgcctcctccatttctgcccacttcaggcataacctggtggcaacatcacaatatatccctgtttctcaaagcagcagacagatgcccacaagagagaaaaattcatatttaaatgcatcccattgtgccctactctccgaccttgtctaatgctgttgttttgagcatagcagagcacactctaacgctcctgtcttcttagccagtggacgtgcaactgacccattgaatgaaggcgggcagtttgggggtttcttccagtagctataacaatatcttgagggcagttatgctttctagaccatggtctcttctggacgccactggccatacagctggctggagctagaagtgcaatgtcactaagcacctgaataaagctaagagccttcctgaaaggagagccttgacaatggtatcatggacccagggctcactgagtaagccagtcaaatagatgagaaagaattcaaacacttttatttctactcgccagcccatcatgattaaagatattcagagtttattgaacagccctggtggcttccttacctggctgaggggtggtgagcctcacatcttttcctggagcccgagtggtgcactcaatcttcctgggagacacgtgtctaatatcacatggaatgcctaaagcgaattaaagaaatttatgtatgtgtgtgtgtgtaggtatacatatatatgtatatgtgtgtgggtatatgtataattatatatatatatatatatatatatatatatatatagagagagagagagagagagagagagagacagagagagagagaggcagtcgggagatgtgatggcaagaccagactgaagtagacaggctcctattctaaggcaaagggctgggtgtggatggaatagcgaaagttgtcaccccaattgaaggagaaaagagagagtgcagagcagcagagcatagggcagcgtggagtattcagaaggaaagccatgcaatggagtgctcttcattggggacgtactgaaccacctaactgagcatgggaggtaagtgtgacatgacagtgtgaggacacccttggtgtcaccaactacagaggcatcccacctgctacaggacctggcaaaacaaaaggctctagacaggtccataaaagggtttgccaaggttggggtgcgggggatttccagagtaatctgcatagcaaatgcccacccactcctgcttgtctatatcaagacagctaacaagggagagtgaagagaggggctgtttttagtagaagtaaacctttgtcaagaaggagctgtatttctttctttctcttcactcacaagataggggcacctgagggaattgcctatgcattgtgagtgtgtctgcaggacattccattcctgtgacccatgtactgtaggaccaaaatcccacctggtctcaaccaaacacatgacttatcaaacatgatgagtcagaaggggcaaagcttgcttcctcctgcatccctcatgccatacagacatataatctcctagagcatctaaaactatgaactattttcagccatttcatcatagttacctgcaatggtaacctgggcagaattgtcaaaaaagtctcctgtaattgtgatgtttgttcttcccccaaggctcccagtttctggaaacacagataatatttctgcaagagttaaaaaaaaaaaaaagtaagcttccaaatatagaccagaatatgacctagataataatataataataggagatattaataatttcttactttaactttctaagtccagcaacagttgaatttttttctagtaataactatttaaaaatgcacataataagaaaaagaccagaagtatatattatcgaggatcaatatttgaaaggaaggggaaatgtggaatcattcatggtatcagcaaaagcccctagtaccatgacattttctcagaaaatctgtctcctgacctcaaggacaatattgacaagtcagggaacagtaagttacaacacaaggaggaatcaactttgggtacactgggaaaggcttcagttcacccatatgaatctgtaatttgctctaagcagaagaatgaatttcactgtctttaggaccctcccactctttcccacactgaatgctccttccccacatgtacctcacacctcatacccagttctttcatgctgctcctgattgtttaaaattgcctacagtgactcaggcctgtaatcccagaactttgggaggccgaagcgagtggcaggtggatcacctgaggtcaggagtttgagaccaacatgaccaatatggtgaaaccctgtctcttctaaaaatacaaaaattagccgggttccgtggtgtgcacctgtaatcccagctgcttgggaggctgagacaggagaattgcttgaacccaggaggcggaggttgcactgagccaagatggtgccactgcactccagcctgcgtgacagagcgagaccctgtctcaagaaaaaataaaataaaaaatttaaaaaaagaaattacctacagtaatatgacacatagtcctcagaatttagctttatctcattctttcctctcctacgatcaagctttgacatttctaagattcattccctccagagaaaagaggagttgcattttgtgtaaactgaaggtacaaaagctaatgatgaatggttacccctgaaaaatagacattttaggaggttattttataatgctttttgcccatgagacaaagcagaggagacatatggaggcaaagattgatcccttacactcagataccaaaattcaccactaaaccataataaccccctgcttttaacccactattttataatttctttttttttacactagcactggaattttgtatcagctttacgtagagattaacacattcttttgttatgcattcaaaattacacagatcaaaaacaaaatttatgaagttcttaaacttttaacatagttgtagatatttgataatttttttcaacattcacagagcacctattatatggtactaggaatataaagatgaatacaaaatagttcctgtcctcgagaagatcagcatggtaaggcaggtatgcaaaactatcatttaataccttgggtcggagaaattagagagtatatgaaagaatagagaactttgggagtaggatgggagtattgaggtgtagaagaaaatgtttagagatgacactaatctgagtcttaaaggatgaattagaagtggcctagcgaagaggagaaggagagggcatttaaagcaaaagatagcctgagtgtggacagaagaaattgcacagtgcatgttaagtgtggctggagtatgagagacagagataaagctggagaaacagacaaggaggaggtcagaagtttgccccatttccagtaggggatagcaagccataagaggatggtgaataggaaggaaccatgcatcagatatatgcttgatgtagagaaagccagggaggggcttgaaggggcagagggcaagtcagggcctctagaaaccactgcagcatgtaacacaagaggtgatggggtccagaaatggagagttgctgtacagatacatcataaataagagagaaaactggcagaaattggtgattgaacagatatggaaaggaggaggaaggagaaattttagatgaattccaagattcttgctcctctacctctttagacgacttttggaataagaaggataagcaccactttgtcagttttagagatgcttaattaaggctcaaaaagcttaaaaggcttaactagtgattgaatgtcagcccctgaggagctcagcccagggctcttcatggctgtctacaccctctcttcctacagcctgctctgctgtgaagaagttctggcctgtgagtcctgatcccaagaagacactgccctggaaatgtaaaagagctgtgtcatcagagatacctgtcagcctatcagtcattctagggtttgatagcaatgggcaggctcacaaaaaccttggagtggagtggcaagaagagtgtgcttcccaccatatattggctatggacataagatttggaattagaactacacattctagctctaagacctttggctttggacaagatactttgtttatctgagtctgtttccttatctgtaaaatggggctaatgttaatccatctcatagttaagtgaaattaatattgagattgtatgtaagacacttaacaaggtctgacattctttctatagcagctatcgttatcaccatcaccttgggcgcttcttcaaacttaccccaaatagactagcaatactgttgaaagaaaggaaaaatcagggtcaaaatgcagctgttgcaggattaggctatctagagagtaaatgacattttctccatgacctgtgaattatcttgcacttttgacaaaggtagattttgattgcttctggaatctgaaccaaccccacagacatttcttcagtggctgtgtgactgtattccattctagaatctaagtattctttagtagccagctttctactaccaaatcgagttcacaattccaagcaagcttccaattttcacattcatttttttagtatgagggtttactcatcagatggcaacagaacagcttaatatcaatattagtcataaattattgaatgaatgctcagagatggatgttaaagtaactggaaagatgtgctttaagactttttaagtgccaccttttttcttttactttcagaagacagaataaggcaagactctcctttcttttattcagtttatatccatagaatttgtatagaagtttattatcaagtctcttttaatatattaactaaacctgacatggatacaagcaatttaatctcaaccaaaaacaccaggctgtctatgattgtagggacagcttcgggtgttaatggtcatcaagaaatggccaaaagatagggaaggaggggccaacattgagtgaggcacaagggaaggggtacttggtgaagggggatagtacctgagtgtgtctggtataggaaaagatcctgtttagcactgatcagccatgccttcttgtggaccattgaccttcgaaaaagacaaagttctgttttgaatgaaaatatcaactgggattgcattttttttagtcggctgcctgaaaggaagattgggaactaacctctattgatctttagaacagttgaaatagcagctcccttggataactaaagaacaataccaacaggacaaagttgttttctgatatataaaattatcatatgggaataatgcctgcttcataggatgtcccaaatgttcaatgaaatgatgagtgtgaaagggcctagtccttagttggcctatagtcaatactcaatagacattaattttatttcttccaaaatgagaaagagagaaaatctccatactttgggctgtatagctataattgtcactgtcattacaaggcaattattatcaattagaccctacgcttttaacagaaacacctgtcaaattatgtaggggcaaaatataaggtaaggattcagaattccagaatgctaatttatcacttcaaagtgtgataaaatgtggaccccttccattttcaagaaggcacttcctagatggtacaatgtatttcatgaaaccatgttccttataagatacttgtgacagttttcaacctacagtactttgaaattacttaagatttaattcccaaaattctgcaacaccaccatattgaaacacacattgcctacagattagtgaagaggacacaacttcattcacccaggtaaaaaagtcaaggagttatatgtggtctcattatactattctgtttttatatgtttaacattttccgtcataaaaagataaagaaagtaagcaagatgagagagataggtaatataaaatgaagacaaatttgcctatttctatacccagttacttactttcctttgttaaatactgagaagctaacattctgggagcctgtaacacaaagaaacacacattaactcaggaatctgcacgagtcttctgggccaggccattgctttcataagcccaaagactccaatatcatcaaattaccacccaaacctgtaatttctttagtggttcccccccgcaaaaacaaacaaacaaacaaaaaaacaaaaacaaaaaaaaaacacctcataagtttagcatcattagcaatgtggacttctagcaataaaagggcaaatgcagtattgcatagcagggaagagcccaggcttcgagttagatggagcaccatttaaatattgatttactggtaactaacttcaatttttctcacctgcaaagccaaaaataataccaccaacttcacaggtgtatgtgagcattaaattagtttctatatgagctgtttcatatagtagtattttccagggaattcttaacaaatagtaattattgttattattattatcctcatgagaaccaatcttgcaattgcttttgtccggatacagagaaagaaatggataagactttaaaattatgttacttctctaacagaccgatgtagtcgccttccacatggcactgcagagtcccaagaccatggtcctcctgaataggataactaaggaaaagacaaactgaggtaagaatgaccagacaactcactaccagaagatctgactctttaaccaggaaagtagaaagcaaaagaaaaccaaatttgctagagaaaatggtagacagagaaagtataatgagttcattagggcaaatgcttagggtaatactaactagtattaccctttatatatactagttagtaataccctaagcatttgccctagtgctaactagtactaccttaagcatttggtcctttcttttcaaatgtgtcatatgacaagtataacaaaacctttatttttaaaaaatctgttatcaagtatgaaccccataaaggacaattctgagcaaacaaaatgcagacacaaggaagactacacacaagggcagaatacacaccagtctgaaaaagtgaaaccatagagtatcattcttgtaatggcctcaaaggaggggcaacacaccctgtccagagtgaagtaaaaatccagcaaaacattgggtatttaaactggagagtgtagaaacttatttctaaattttttattatttttacctttggctagtcactgaagtatagtggttaagatcatgaactctaggggatgattagttagacagggttcaaatcccaggtctgccacttgctctctgtgagaccttgtgcaagttacttaacttttctgtgtctcaaattcctcatctataatgtgagactaataaccatacatactcccaagattattgggtgacttcaatgtaaagcattcgagcagagcttggcctatggtaagcccctaacaagtattagctatgtgttttcaaggaaggttttggcatccacttcaatacgcactttgaatcaatccctgtgtctttttcagtagtctaaagataaggtagtaaatagctatgtgtgatttatattttaaaaaaacagatatatggtgagtggggagagaaagagagagaatgtgtgtgtgttgtatccatgtggacgaacttacaagcatgtgcattggcaagataataagacactcaccagcttcccatctgcctatttataagagagcaaggagtaacccatttgtctccttgagcttccaagatcactgggctggatttaaaaaaaaatgaaaacaaaagacaagagataattgtgcaatactcccaataaacattcctcacaaaactcagaggaaacatggctatgaacactctcctctggatttttctgcactattgcaggtggctgaaggcggatgtcaagtcaaattctcagcagagagtagggatgcactcatggctcatgctttcacactaaacagaaaatagttctcccttcccaaaaaaccttcatcatctccacactggctatattgattctacacagagataatattgcatttatgcctttattccccctttcaaaggctgtatcccagaccaaggctgagatgggatcacctagcaaaatatggcacattcccaaggatgtagtaggagtttctaccccccacaagaagagtagttttcttgtaaggtaagttgaccattgcttaatgccagaaatgtcaatcctgagagtaataagatcatattctcttcaactagggcaaaatcagacagatggagtagaacagaagaggatgcccccaacccatccagagtgaaggaaaaattagacaccatgtatggaatctatgcagctgagtatatagtaagatcattttccttctaccttataaatgctcagtacaattgcttcatttgttgaatgattacagttgcttagagcttcctacagcctctacaatttcaacactttttgtcttgttctctctctccagtgtggatgatttaatagtaacactttccaccacgtctccagtgaagaaagtcatgttgacatcctaatcattcccagaaaacattaaaagctctatggcttttaatacctgtgtccatgttttcctctgaccccactaatacaatttttaaagcacaaatggataacaaccaaataagaaagttataatgggcttttgggtttacacatcattttataaagaatctatttcaggctgagaaacaaaggaaggaagggtgagaattcaaaaagaaaatccacagatgcaattacagttcatttcacactgagcccagagtgactagttgtcagtaaataaatggaccaacttaattgaccagttgcaattacattaacaaagtttgctgaagcccagctcatgagggaccataaactgcaaaaaggaaaatagcaattctgtgccaactgcttacaatttattgccatcagggaagctggtcccaggaagccatgcagcatgtatgtaactagttaaacacaaaaacaaacacacacttacctatcaatgtactcagcatcaaaatcaaaagtttccaatcttccagtgataatccagccatatacatgtattagttttcctgtttgaagaagaatttttttaatttaatggacttagctcaaactcaatgtataataaaaaaccatgtttctttttggttgtatatactcaatatggcaaagcaggtcatggcccagaaaattaatacttttaataaattgtacaacagtaaggtcaagggtatgatttagtgatcaatattacacaatataaaagctaaaataagcaattgtttcaatcacagacttaatcttctaatgcatggagcatagaaggaataatgggtcttcttcacagtctcagattgtgtgaacatttcagaaaggaggggctcatctccacacactgccctgttccattctcttggctctgtggagaccatctacccaacacgagatttaaggacaatgtgccttgggtgctccaggcttcatgagactttcctctgggcatttgctaaaatgaacatgtgatatgaagaggctcatatcacacaatctgatgggtcttcagggatcccaagtatgtgccttccaaataattagaatatttaaccatgtatacttaaaccatcacagacaatgtttagagataaaagaatgttggttagtgagataaacctcaaggaatagaagagaaaagcatactgagggactcatgaggtcatgaaatccagaagactgagcctctttatagacactgaatgccaccaaagaatgtgacaaaaaagatgttcccttcctactgcacttgtgtgttattagtaagaagtgactttcatctgcactcattggatgactctcactaaaacaacagaaatctttcggaaggtattacagccacaattttataggtgcatgggtagaatgacctaatgacaggcaaaggtcacagagttggcagaaatccagagtctcaagtttcctgttactgctaaaaaaaatctggcagaataattctaattttaatagggctaaatgatcgattccctagccttggtgagtatgacttctagctttgacaggcacaattttaaaactaacaaaagactgtagaaattaggaatttctgtgggtttttgttttgtttctaaacgaagatggccagcacaggctgacaaatggccacaccagagcacggtgatgggggattccatgtcgtagtgaaggactgctaaccacgtatagaaacccaactgctcagaaagcatcgtctctcttgtccctaccacctcccccatctccctggctgctacactgggcaggcttcccaaatgaaatgagagtattcatctggaaagtgattacaaagatgcagtcgtatggatcctgcccaggggggaccactccaacccagcccgccaccaatcctttccccagaaggtggaagagacaccgagcagaactccaacttggtggaagaaatgggcttggcagatctgggcgccagctgacattccatttcacacctctaatggctgtctgcttcctcatccctcaccctaacaagacttctgccatctacacaggagtttctaacatcagagcagcagggacccacatgtctgcatgtgattttcacagaccacatccctctttcataaaatatcaggtcccaatgattcagacaaatggaaaggagcagatctgtgaaaaacccacatgagcaagagcatgccaaattcatattctctgaaatataatttaaattcactcatacataatctgtgtctatacacacaaacacagaaaatataaaacgcttttcaataacttagatcttcattttgacatgcttgagcagttgagccaatcaaaacaacaagatccgtctatgcatttagacacaactataataaaaatttagcaactttttagcacactcttaccattttggaaactctaacaaatggaaaaccttaaataaaggtaggaatttggcaggaatcagacagcaaattatatataatcctagttgtgtttgctacttagttttaaggcagatttagcaattcctgaatccacttctcagttgcaatcccttcttttatgtaaatcccccagctttatataatcttcttttctatcctcctggcttttaaatatctgtgtgctctctaactttataaacaaaacccctagatgaagactagagttaatgaccttccaagtggcatccaatgctgctcaaaatatgacagaatggtggatatatgggccactctggattctggctgtctggttcaaatctcagctgtggtatttagtatctatatgactttcggcaaatttcttaaccttttgctacctcatttcttcaactgcaaaatgggaataaaaatagctcttctattatcaggttttggcgaggatctagtaagatatctgaagagcttagactggagcctggcacacagtttaataaaggtttattattatgggaatgattataaagttaaaagcaaggatgactcctctttcctccagtctccaacatcaactcatttgattttgctgtcctctttttcttttcatgtttggattccttttgttatcagtgaagtaatagagcaaaagtgcccagaggtaaaaccaaagcacgttaaaaatgaaccagaggttgactcttattttcaaaacagcatcaaagaagaagttaaattttcccactcataaaaaccactcacctaggtttgcaacaagctttggcaaacagattcacaattattcctattttaatagaagatttcttacctggaacaccacttggtggataaacttggtgaacgatgggtgtctgcgccttggaaaactgtttagaaaatagtaccacaagtgagcatgtcattaaaatattcacaaacacaggaggcacaagcctttcctcagacagcattacttgaaggtaataaatgcttatatttactcatgtcaccctcacatctgtctagttctttttatctttgtaatatttctatgaaacagaaatgatagatattatcatatttctcctatagatgaggtagaggtaatttgattaaggtcacatagccctctattctgtaccatattgtccaaaccttgacaagcctgtttctacctgcccaccttccatacccaagaacacattttactagaaggaaaggtagacaggtctttgtgcagaatgtcagtcttttaattccattgtaatttgatgttttggggccttgaagattttgatttttctagaaaggaatgcacttatttaattgaatcaaaacttcaaatcattatcagccagcaccttggtaggtatcagtaagctacaaaaaaatgagaaactggataggcacacaactgaggtgcttactagggaaactgaagatacctgctgtgagggaaatgactcaaaagattcaaggaatgggaagcaacattgttcttcaaggaggaggaaagcagcctcaatgggagcagtgagagcctgagaaagcctggcggtagcattccaaatcatcttacaatgccccctgtccccaaagcacaccctctgttaaccataagctccacaaaggcagggacaatgcttgactgagtcgctgctgtgtctctgtgcatagactggtatgcagacgacattcgaatttttgtgaatgaaaagagtcacccaatctgggatgactgatatactgcctggaaggagaggtgagaacgaggcaatcccaggaactccatctcacctgtaggcatctgtgttagtctaagattagtgcattactccatcaggaaatcacagcagggccagtatgaagaaacaggaaagcttaaggatgaactggccagaccaaggcttgacctgtgagccaattacttacctaggaagagacctagtctccccttccctcccctcccccaatcccttctagatgcctagactaccaccattccacacaacctacagtgcttcccatttgcaaaacaaattacagcagcaaattgttttgtttggtctgcttccagcacctcaggagtctaccttcccagagagaacatcaccaaagaataactcggttgttaatcaacagccttaatcagattgagaatcaacagacatttcaacaaagctgatggtggcttgccaggcgtaggttttaagtattgatccatatgctgtatagtctgccatgaaggctagtttcctcactgtctaaaggaaagggttagaaaatagttcacagaaaatatgtggtgtcagggggtcaaaataacaatgttgttacttcacagcttgggaactggctctgatctcaccaaaagataaagattaatacagttacacacacacctgccaaacattcagtccccaccccaccctcccagccaaccactgcccctaggccttcatatcaacattatttcaactggactatatcataggagcttagtgaagtacagtagtggttattgacctatttcacagatgtttagaacctgaggcagctggaacaactgagtccaaaccaaataaggaagcatacctctctatttcaacctgaaatctaagagccaccactcagtctataatccttctaccagacttccatgggaaacacagcaactcctttattactccctcccagctcgtgagatcgtggtggggcaggcttggggttaaacctcaaaaagggcttcacttgtgattctctctgagctgacacaacataacatggtacgtttctaagagaaacaggcccctggtcacccaccaggctagagacatgacaaagtgaaaaattaatgagcttccaaatcaagcttcccgcatgctgatcctcgggccccagtgtggtcagtagaagcaaaagaggggagaggaaatgcagcagattaggatgagaaagctgcagccaccagctgtgtgatcaaccttctgtgagttattcaaacttgtcagcgcccacagcaggctctttgcagtggactggcaagatgggattaatttttaatactcatggttccccagtcccagtcccaaaacaaagagacacgccgtgttttatttagcctggaatgcctctcattaactgcatcccctggtgatttttcatcaacttgccaagatagttgaaccactgacggacttgttttctttcatgtgcaattttaggaaacgtttctcttatttccccctctcgctcctaaccaatcttttaataagcaggaaaactaccatctggggtgaaaaggatcatggtgattaatgcttggacttctctcttctgttatgttccctgagacaggatagaggtggtggtgcagctcttagtaaaaaagaatgatataatgttttttctttctgctgcatatgtgcaaaagcaaaattccagaaaacaagattctcttggattaagaaacaagttattaaacctgaaacaacagcaaattccaaatttcaaaaccaaatagcctatatgaaacacggatcgtaggagagacaaatttacaaggtgaagccttattccgaaggagcattcattagtgactgcattgtatgttttgaaacagctcttaaacagaggtaccccatgtgaagggcaaccacatcgacaggagtaccgccaaatctctgcctttcataaaccatctaggaccttttcagagattgtttaaaactaatctgaaatgaacaacagactgaaccaaatataaatgaactcccagtataggtatcaaggctgtaaaataagtcaggcatggcttcctaaacactctctctctacttcctttttgatctccctgagcatgaaggagaattccagcagcaaatgcccttttggttcagtgttggaaagacttagcagaaatataccaggaagcagggagagaggtagaaattgggtctcctcaccaaggaacgtggggccttgagtctcttcaacatgctgagactcagcatgatctgagctgtaaaatgaaacacccacaaaagtaatcttggtggcccctctatgggcttctattttgatgagaatttagaaccagatgcaagttgaagtcttggttctgccatttactgcctgatgacatgggcaaattatttaatcaccctgagcctcagattgttcatttgtaaaaacaggacagtaaatagctaccccataaaattgtgagcattgaatcaaatgatgtacataaagcatttagctaaaggctgacatacaaacgttcaaaattcatctttcattagtataatataagaaactctgtcattaccatccaccattttcttttaacccggtcaagcagacacgctggctcatttacaatttgcctttcaataacacaagcacacccttagactatgtaaacataccttcctccagccttagaacccaccttgaaagtacagctatctcgtggtcctggatttggactgcttaccagctgtcccccgaagtatgcttccaggaagtacagaccctcatgtgcttcagacagcacagatctgaggacagaaagtggaaatccttatgaatcaaaaaccatgaattcccaaagctagcagcccacttgccacttcaaatttcctccttgcacttttaaaacagagctaaccaaggattcccagcagtcacctttcacctctttgatccactcataattattagactttaagaactgggtccttcagcaaaaaaaagttatgattttttgtgttgaaactccctgaattgtttttaatatgtcatgtttctcaaaatcataggttcattggactttaagaattagaagagactttgataatctattccccatttccatgtttcaaaaaatgtcagaaaaactaagagacttatgtgtatgagcttcaaacgttaagggcaaagtggggcttgaatttaggctctttctgataattgtccaagcagcccataaatacttcatgtagccatcaaaacagagtcttggatcttctctcctctttatacaaatattgcagtggcttcattgccacctgatgctgacatccatgttgatttttgtaagaggaagaatatgactaataagaaagaaaccatatttaagacatgcctcctctccaaaccttcccaacaaaatctttagtatgaccttaaatatttagatctgaattgtccattgtgttagccactagtcttatgtgcttatcaagcacttgatatgtgggtagtcccaattaagatatgccatgattataacatgcacactaaattttgaagacttggtatacaaaaaagatataaaagtatctcattattaatttatatagattacatattgaaataatattttagatatgttgagttaaataaaatacattattaaattaatttcacttgtttcttttgactttttcaagtggctaaatagaaaattttaaattacatttgtgttcacattatattttgattgtgaagtgctgcttttgatgctgcaatggctgttttagagaaaacaattatgtacatgtttttatgataatgatgaataagacatattttgttcatgaaaaactgtacatttttcacacttaattgaatctgatatttgtcttccaatcaattagtatatttaataggatcatatttcttttctttaaaaagatgacataaaatcaatggtgcatccaaaaatcattagtatgttgggataaaggagataggacatgtaaatctccagagctttgacttgtttcatggcaagtctttgcagaatgtctatgcccaaatgtgccataaaatctaagggaaatatataacccagttttaaaaccaatagtagtggtataaaaatgttaaattcaacagacatttattgaacatcctctactcgtaagatattgcgcaatgcatcatgaggactacaatggtgaaattaaacacatcccctgccctcaaagcacttaattctgtgaggaggagtctgacaagtgggtaactgacatataagtgttatgaaaactcagagctgaggcacagggtcactaaggctacacgtgctgtacctttgtgtaaattacaaaaaaaaaaaatcccttcggggtgatgaattgcacagaaaagtgtgggtacacacacatacaccctgtggatgaattactacaagttgttccttctcctttcaaaaaagggaaagataacttagttgaatgttcagggaaaaggtggcatttgtggtatggttggtgatttccatagccaaacatggaagagggggagacttcctcaaagagagaacagaaaagaaaaggaaataacagtgttttttttctcttaaccaatcatctacttgcatgcactttatttactcatgcctaagacatgagtaaataaaaatgaacatgaactagtctaaatttcacagggcaacaagaagttgagtagaaaaacagattccctggagtcttataaaaatattttctaaatagaggtaatgtcaaactcagcaaacagagcctaaagcaaatttcttttctaaccagtttggggtttatgtgcaatcattgcaattatgcctattccaaaagatgagtatttgcaatggcaaaatggtaccatttattaaaatcttaatagccatagaactctttgcaaaaaaaaacaaatggaaacacaatccagcccctccttacgaatatctcaaagttcttccccatactctcatcctccgttaagttctagaccccagatagggaccttttagaaagcatattcacatgaaactttttttaacaactatggctggcaattgaatcacagcaaaaattgctctaatatgtcaccaaaagatactgagataagcaaaaatccctcatcctgtctggtcttcctattcccagacaggtatacctggtccggcatgtcaccacaggcaaatccaagaaaacaggaaagacgtcacagggaacactccgcagtgcgggcaccaccatgttcacgttcaccaggtgtatctccaattgagagccattgttggggtaaagaacacccaactccaaacctaacacaagggaaagaaatctcaggctgcatagaattgtcattgacacaggacagtgtgaaactgtgctaagatcctgggggtaatgtaagacattaaatttgcccaaggattaaattaatactcctcatttcctcatagatgctgtataaaggagttttctcatttatgattttatgaaagagttttctctcttcaggttcacctaaatccagaaaagaatttttcagccctcagatttactctttactctgctggggatggatatgctaagcaatggtgcagaagctcccaagtagaggactgtctttaaggaagatagccaagattctgggagatgcattgctgagcactatgctacacacttccatatcatctcatgtagaaatcccagagtcccatcccacagcctggaatgggaaagtggacacagagttgtcatggtatgctgtgctttgcttctgtgacattagcaagccagtatctagaaagacagaagttggtcagtctgttcgtctcccttcaggcccacttttacacctgtccttagaaaaggaagaaaaccaaagactcatagtctttaggattgtgggtcaatacataagaaatgtgcacttggtaaaaccccaacctaccatcaaaaatgactgtgatccacgttccccctgcaaggctaccttcttcaggttcaatatgtaaactcaggtgacgtactgtaagtaagtgaaaaaaaacattggttttgaaggtcagattcaaaccactaccttctgcaatattttaagcaatatttaacctgcctcagaatcaccagaaaggcttgattaagcacaggtggttgcaccacatccccagagtttctggttccgtaggtctggggcaggcccaagaatctacatttctaaccaggtgctgctggtgtgggaaacacatcatcagaagccccattttaaggaaaattttgacaaattcttcttatcttagacattcaaaaaccctgcactcatcaggacaattctgaatttctacttcctttggaaagagcctcaaggacatatttgggtcctaatcaaacccatactgtctctctctgctctctttcccactctttaatcaggtggccatatttccctgtaaagatcatcaatcatttccagtcctggagagaaaaaaggacttccattaggttggtgcaaaagcaattgctgttttgcattccttttaatggcaaaaccgcgattacttttgcaccaacctaatagaagctgttcctatttcaattctcctgctcaatatactgcttaatatactagttttccctcatgatcagaatgacttcccaaatgaatacaaaattatctagattcttgccttgcctgcttagagagggggtgaagcatggatcattgctggaatttccttttgtttaaaaaaaaaaaaggcagtatagaatttatatactaggctagattggattctcctgtatagatcaccagctaagcatgggccttaatctatccctccatctttgaagatgttcctggacaagtcttgatgaaggaaaggccaagttaaggaagccagcaaaaatcatgcagctgctcagtgaggtaataaacaaggaaagtgttaccgacagaattatttatagtttctttagaagaaactgtgtctagcccaggacttccctgtacagttattctcatgatgcacttcacatctgaaggtggtggggaaccacgtcacattagcacaaccatttatggcagccccagccagactagaccatcttccaaagatgattagatacttctatctaaagaagccccaaaacaaaggccataaaaagatacagaggataaccaaattcgcagagaaaattgaacagatgatttgagataatacaagcaatctaatgattatgacaagttaatctctttgggaaagtccgacagcaaaatctaaaaagaattacatcacatagcccaaaaggaattataaaagaaaggttataagttattattaaaagctctgcactacaacaataatcttcactgaccattaaaaattgaagtatatagtcataacatttcagtatataacctcagctgttaaacagaaaataaaaacaattattcaacatataatttaaacccaaaagcaaataccttaacacctgctctgaaaacagtatttttaactcaattttttgattggcaagttaaaaatgcatatatttatggtatacaaccaaaatattactttaagtttcaataatagttctcaaggtaacctattgtgttcttacctataattccttcaaaacacattctactgacctgccaaaagtagtacttcaatactcatcagagagatcagccaggcagtcattctgtccacttaaatcaatactcttaagattgctcagacattaaaagcattttcagttttgattggagcagcatagcttttgtgctttataaaaacaaaaaaagcaaaaaaaaattatcattttgtttacatacgattattttgctgttctgaaacctgggaaattaaggagatgagataaacatggccttagtgtcttcaaatggagccaccatttttccaagctcaggagaaaaggatcatctgagaaccttgcataaaatcatccccactctgccctccttgtcccaccaacttattttaagctggataaataataacctctttcattaactcattattgaacagaagctgagttttaaaaagaattctagaaattaaaattctagttcgtgatagggtgaagtctgttttgctttgccctgtgctggcgtccagctttccctcgtgctgctctccagtttgaaccctacactgcagccacacgccgttctcaccgtcactcagacaagccttccacacatcagcctctgccttggcccctgctggtcccttcctggatgccctcaactctctccgtggcctcaggagatcctggcgcaccttcgtggtgctgctcaggagcccctcctcagctgattctttcctccgccattccagtgctcaccaccttccccctgaacctctaacttccgtgctgtagagcctagaccagataatgtggcacacataggcctcttcttccagacggcacgttccttgaagagacccaggaaccagtcttctatttccacagccttcctagtgtgaaagtgtgaaggtcccacacagcgctcagtacattggagtggatgaagacatatttgaataccctaaatctgggtttacctaatctgagatgaacagctttcactctcatgcctgctctaaggaaagtgctgagctgctctccagcacctcatggcagagggcatcgacaaaatcctcttaaaaatagtgcctctgaaattttctgaaagtttgaaaattacagaattaaacacccacatgtactactaaatacacgtttaatatatatttaattatgtttatgtttattacatataaatatataaatatatttaatatatatatacatacctacatacacacacacacatacacacacacaaagtgtgtgtgtatgtgtgtgtgtgtggcagggtctcattctgtcatttgggctggagtgcagtggcatgatgtcagttcactgcaacctccatctcccaggttcaagtgattcttatgcctcagcctcctgagtagctgggattacaggtgtgcgccaccacacccggctaatttttgaattttttgtagagacaggttttcaccatgatagccagactggtcttgaactcctggcctcaagtgatctccctgcctcagcctcccaaagtgctgggattacaggcatgaaccaccacacctggccatttaatttatatttttaagaaaacactgagattagcagaagtagttacatcatttctgaaaatataaaagctacaatatactccccccctcaaaaaaaaaatctgcaaaaactttgcaataaactcaccttacgggcatgttctgattgagacagctggaaatctataatcatttctatttaattcaacactgcaaacatttattgtatgcccactacgtgctaagcactatactaaaagttgggaaaacaaacaatctatgtacctgcccccgagtcattaccagatagggtaagtgtggaggctacttggatttaagaaaggaattctagtattttcaagtggattcagcaagtgttccttttcgttgcaaaattcccaaacttttacgtctatttgaaatagaattcaacttataaatatacaactttcagaatacatctaccacatagggaaaagtacccaagcgtatttgctgcttagtccaaaagcatgagatctgacttgcttgttacacagacaaaatatactcagcacaggagagtctattttcaatctggctacgtgattttaacatttcttcttaatgcctactcccaagctcagaacaatagaaataaacattcgcacactggttttcttaaaaccctacatttggaactgcatctttttcatgtcaattataaatgtaattttttattagtctatccactaattcttcctaaaaataaactcagactctctttatttctcataactaaaatttttcaaccacagaggagagctgtgtgcatttatttagtcatgtttttgttctcctctctctctctcctctctctgctctcactccctcttcccttcttcctcccttccctctcagcttctcctttgggacatcgagggacaaagttgcaaggcactactatagatctcccatttcttccttttgttcaccagaacgttaacaagagatacaacacctagaaaacagagagcagagacttttctggatcaaacagtaccttttttttctgtttctgtctccttgtgactcaagggagaaatgatcctttctttctaagtgatcttatttctctctgtcaagaatccgtggacatgttatctggttagagctcagcctgcagccaccacgcaggtaactcactcacgttagactataactcacctaactcgtttgtgtcccagccaaatgt

SEQ ID NO: 240 - DNA, 366777 bp, Homo sapiens
tgtcattttgtacatacagcatttattacaatacttggcatacagtaaatgcccaataagtatctgttgaagaaatgagttaataaatgagtaaatgtcacattgactttatgaaggaaaagatctggcagcaaaggtagcaattttaggatagaaaggaaatgataacatgggtaagggaagtatttgagggtcaataaggctctgggggaaccaattcctcaaatcacactgtatctgtaactatttcctccatcagtgcacaagaatggcacactgttccaataatggaacactgggcacatgggagttatttatatcctactgcttaaggtcatggccaaggtctgattttgcaattcaaaaaattgcaacctccagcataaatgggttatctttaccacaccaatattcttggtaataaacttacatttatgttctttctttaccaatattattaacaataacccactattattggtatattagtattagtatattattgataatatacctatattattatattattaatataccaataataatatattaatatgccaataataataatatctcaatataattggtaaagaagagagaaataaaataaggcttctctaccatattatttcacctatcactttattccagataatttatatctagctgcaatttatctccaaagctctaattccaaagatttcaacaccaccaatttaatatctgaattgctcctctctcatatagtgggtaccccaaactcactaaaggcaaagcttaagcaaccatcctcttctttcctactcccccatatctgctactggaacttccattcccaaagatatcctgactacggacaatggtgtcactgttgacaccctctccacagtccccaaagtcaggagtaagcaaactctatttcctctcttttgtatttctttgatctgtaccatcctctccattctggctgccatcaatctcctcccagtcctcaatcaatttcttctcaatttgaacaattgaaacagtgtcttaacaagtctttccatttggtccatgctccaacccattcttcaccctgcttcctgctgcctcattaatctttcaaagttcagcttcctgcaggctcctcctctattctgaaatcttcaaagcctgctcagtggttactgaagtaaacagaagtactttagtcagacattgaaggctctccaaaaatatgtctccacccttcttttcttctcggcatgctttccacattgcatccaaatgaaaataccccacaccttgtaatatccgagctctttactcatgcccgccctcagtgtggagggtccttttctccttctgccaaaatcccactaacttggagctctcagagtacagattatacatttctaggtgcttatcttacattgctttatattacagttggttacttggattttccttcttactgaattgttatttctttgaggttcaaggttgcgtctcacttatgtctaaactccccagaaagcttatataaacgaaagtttgcacattaagaaaaagcatgggccctgaattcagatggacttgaatgcaaagcctggctttatcacttgatataaaaaagcaaaggccctaaactctgtgagcattggtttcatcatatttagaattgattaaccagaggcttattttccaagttattgtaaagacctgatccgtaaagcatataacacaatgcaggcatgcaagaggcacccagtaaatgggagctattggaatagtagtaactattaccacattgtaatatataatcaatatatattggttaaattaaactaaaattaacataataaatctttcctgccctccaggaggatataatctaattggggaaagccacatgctaatgtaattaaccattctaagtaaaatgtaacatgaatgaatggaatcagctgtaagttccaaggttatgtgaagagaaagactgacttcctctcagggtggagaagacgtcccatgaaaaaaacacaggacctctgcaaagtctcctgcaacagggaaccaccacagaaataggcctgctctgaacaataaagggtcattctcatttgttttcatttttgttttcaaattaggcatgttttaaatgagtcattaatcatgtacttacttcactaattactcatttcttttctagctaattttttattgaaaggcatcctaaaacagggagaaaagatattgtcttgaaaaagagaataaaagtctgctcagaatcacatctcagttttttctctaagaccaagtgtcagaatctgatgtgatagtctatatgatcttaaaggtgtccttttgctcttgggacctctgtgatgtcagctccaacatggaaaatacaggaaacagctaggaaagactgtagtgatgagtcccattttcaacagattccaagtgcacacatatggtcagtctaaatagctttctccttaacacaaacagagaaaaccttgttagtgctcaacctcctgcactattcattccccaacatgcgtgatcctgtttggagttgggaatgtagggaatctggcctttctaattacctgggtactgtcacacagatcaatgtcagagtatataccataagactattgactattgaagaacaattcatggtaagtaaagtaattttaagaaagctgggaaaatgaattattgaaaatttcaaagtgtgataacacaactaactccaaaacaggaagtgaaaacaagattaaaataaaaattgatggtgaaatgttattttggactagttatgtgtgggttaccaagagtgatttaagatattttctttcctctttctccatctctctcaaaaggagaaaggcgaaagaaaacatcttaaatcaccaggtctgggctttccagatgtaattccagaaagagagaaagacagagagagagtttgggtacatagaatggtaccccaaagtatggtatgatgctttggcatactgagcacttttgaattaaaataaattgaaaagccttagaaactgcctcagaaccagggactttctaagcttctcttatttctaccacctccccaacaagtgtagaaaggtatttgctctggtatctgagtgaagaaaccttcttccaaaagaaatgcaattgtcttaagatcccctttctaagaatcttatcaactaatcaggaaaaattaaccaccagagaagagactaaaaattgtcatatgcccacaaaaccttttcacctattcttctgagggcagctgcaaaagattacctgagagactgtatctgcataataagacaacctatgttcacagtgtactttctcccctcaccttcttataacttgtccaaagactattgtttgtccttaggtcccattcagtgttcaaagggagtgatttgcaaacaattatctagtctttgagaccacgtactccccctagaaatcatttactactcctctaaactgcctatagcccctcataccactctttcctataaagaaggtatttaagccataatcatctggcccttctttgaatctgatattctctatggctcccactcttacacacattaataaatttgcatgccgtttgtcctgttgatctatttattgtcagctcacctcagtagactggagccttcagaggaggaagaaaaaatctctgcactctactattactatctatctatctatccatctatctaatctatctatatcttgaaatcttggaatcactgtgtatgttagtctgaataatgaccctaagatggccatgtcctaaacatcagtatctatgaatgttatcttatatagaaaaggggactttgcagacataattaagttaaggatcttgagtgaggagtgtatcatggattatctagttggtaaatgtaatcacaagtgtccttataagaaggagtcctagggatatttgactacagtaaacgagaaggcaatacaatcacagagacagaaattaaagtgatgcagtgaccatgctaacagcaaggggtgaactagatagcaaaaaattttaatcatgcagtgaaggaagttaggacaacccctagctgtgaggttataggaagaaaagggtcaaagagaggaactactacaaatgcacctttatgccatgtggctcagatcttcttggttggagcttttagtaataaaaaagttaaagtaggtccagaaataaggagaagctgttcaaaatgagtcaggctgctggaaaacagaggggggttcctgtgatccctctgtgtccctgcagtgggaaggaccctcgccccaggctggtgaaggtgcctagctgtgtgacatgattggcatccccagtgtgggaccatgtaaaacctacgtatctggaataaggcctctggatcttttttaaacaggactgaacaattgctccttgttttgaaaaacttttctgttgctgttggtattttcatgtccaaggcaaacagagagtcatgtggatgctcagaaattgaaaccttgcccctgttttggaagagatgtgtttcagcctgtccttcaaagggatttctcaccatgcaacctattatgttcatattttatttggaaaaatggagagaaagagaagaggaaatgcaaagaagaaggaaaggaaacagaagtatgggagcaagaaagtccaagaaagaaagagaccatcgggtgcttgtgcatgactgtctttcatatggaattaatggtggtttaatggggtatgaaaggatgttttactggaaacaacgaggaacaattgtctagctcacgtttcatttcacaggtcattattgcattaagaagtaaatcgaccaagtctggtaaataacagtctgtgtattgccgagagcttcaaaccaacaattttagccatcacaaactaatatctctgtcattttaacccttgcagggttgtgctagggggctaaacaattacagtcttcacccagttctagaaggtgagcataattcattgcccttctagtcccttcttttgcaaaacccaggaggccatattttagcattgttgttttgttgatgagccagccttagccaaatgcagctctggtggccttgaaaaacaacccccattttagtgagtgctgcaggcatctttaaacacactgcttcctctgcaaaattaattgctgcaaaatgcagtgctccctcatctaagcttttgcaagctcaaactcagctatttgggtaggtcatagatgtgtctgagagatccagggtaaatgagctgcttttctttattatagaagttcacgttcatgtcaccaaacattatcaggcactggacatacaggagtttctaatgcttaaattccggttccattaactcaggggcaattggtggatgaggccaatcctggccgtattttgaagcagttgtgtagtaaataaacacatcaaagagagtttattgtaaacaatcatacttaaaatacatatggtaaaataaagtgcatattaaaataaaattttcttgcttcaacttgggacaaaaatgtcaaagacaaaccaggctatactggccccgcaggaactggtcttaatcacctcttttctgccatcctatccatccttttacatctcttggtataccccacatgaactgacctctgttccctctaagttcccattaccgcttcatccccctccagcttcctgggccagccccatatgaactgtcaacatttcctcataatttttcaatcaaaaactgatgtttatcctacagagtggatatggaattctccacacttccacagtacctctaaaatgtggtaagtaaggtctaatttctttcttgaaagagaaaaaatcttgcagagatggcatcagtattccaatgtcttactttttttatttcaactaagactaaggtcttacaaataactatggtgtgctgaataatagcctccctaggatgcttatgccctaatcctgattatgtgaatatggcaagggactttgaagatattattaagtgtatagatcttaaagtaggaagactatcctggactataaaccttagaagcagagaactttctctggctagaattagagagttgtagtaaaggagaaggcgggagagattcaaagcatgagaggcacacaattagctattgctgattttgaagatgaagacagccgcaagtcagggaatgcaggcagccctagaagttgagcatgaagcctggcctacagtgaacaaggacacagcaaccataactgagcagcttagcagctgagcctcaaactgcattttaaacttttttttcttattttccttttcctcttttctcttccagtctcgggataaaattttgagacaaactgcatatgttactgatggaaggtatccgagttaccagcagtaaatctgtgtgggtccgcagcaacctcaatttctgcctcctcagatgaaagaacttgacagagggatataaggcagaaaaagagaccgagacaagtttcagagcaggtgaggaagtatattttaaaaggctttggaacaggagagaaaggaaagtacgcttgatagagatccaagtgggtgacttgaagaacaagtgtggtgtttcactgttaactgtgatactaggactttacagggtggcccccttctggcgtctttaaaccccttctcatgattcttcccttagggtggtctgcccacatatgcagtgccctccttacccttgggaggtgagcatgcacagtgtgttaaggaaactgtatgcatgcccatctgaggctttcttccctttgctgctggtgtgcccctggaaaggcaaactctgccatttttgtctcttagtgcatatgcccaggaagttgcttcttcctggcgtctccattcaattaacacttcagtgcaacaggtgtggcccatcaggaaatggcctcttcctggcaccatctgccaatctgtcacttttagggaggcaatgtgataattgccaaaccatcactcaacattcctagtgggtaggggagagccctcttctgccctactctatgcctgtctaacaacctataacacatctatgtaacctctcatattaaaatacagcctcagtatgtgctgtgaatctcaattccttttccttctccatacaatactcccatgccttatgcacatttatttacctaaatgcttgtcaagcacgcaccatgctttcttatctggtcatatatttccttatatactttaggagtcagatcctgatagtgacaaggcacctctggaattctctctctaacaaaagattgcttaaagatggaacccactcccagatgatgagtgactacaaaattgactgaaagtaatttataacctggcagggtctacgatggcagcatcccctttgccaaataggacaactgttcaagaggggccactggagcaagtcacgctaccttatacctctcagcccccacacttcttctgcattccaaatctttcctttaaaaacctctgtggaattgaataggggaactgaagagtggaattgctttctactcttcccctgctagcatggataataaaccaattttgcttccttttatcacaacttattattttgacttcttttcataagcagtgagcagccggactctttggccggttacacgaccacagtcctacaactacatggaactgaatctggccaagaacctgagtgagactgaaggtgaaatcatctccagaaactccagaaagaaacacaatcctgccattacctgaattttggccatcagagatctgaagcagagaaaatagccaagttcaccagacttctgacctacaaaactgtgagataatacttaggtgttgtttgaagccactacattgttaataatttgttatagcagcaatagaaaacttgtacaaaaaccaggatgtcatgctcaaatgttcatcaccattccaaccaggatcatgataagtggtggcagtggtggcaatggaatggaatagtcaagttatttagtgcttatcctatgacaggcctggggccaagttttttatatgcattttgtctacaaaattataaagctctaagatttcctttgtctgtaacgtgttcaaacagaaagacagtatatagcctacagatatggataggctggtttccacatgggcagtgcccaagaaaggttgcatcctaccaatatcacccaaaagggaagagattattattcatagccatattaaaaaatggcttcaactcccttccttcatggcaatgactttcaagaacttacattcagtttttattaatatttctcctgtgaggaagctaatcaaattgaaattcagtcatactggaagtccttaattctgtagtagaaagattggcttctaggtctaggaaaatttcttttctttggtgttcttttccttgacacactttacataataaccaactcatgtttcaagattctagttttccatataaatgagttatactatcattattcttactataaaaactaaattatacatacacatttttttaatggcaaccttctagtttttccctctgagtagtagtgctgaagatcaagatagcagaggggtaagaggcatgatatattttctttttcattttctgttttactgttttatttattcattcaacaaaaatctctaggataatgtcttaaaagtgaagttgctaagtcagaagtacagagctttaggtggtagccagatgacaaaaagctaagaaaagtgatatttgagaacgaagtttgagaactctttctccacattttccccaacactgcaaattatcacactttttaattattgcaaatatgattgggaaaataataataattatagtagcagtggtcattattgccttagaagtggtggaaatctttattaggtttatctttttaatccttataataatcatttgagtacataatattaatatctccaagtcctaaatttaaaaactgaggcataaaggagatgagcaacttgcttacaattgcacatctggttagtggacacaatccaagcagctggactcagtgcaagaactcttaacctgtgctttgattgtgagaaaactttggctttttgtatgtttattgatatttgtttcatttctctgtaaaatgtttcttggaattctttgcaaattttttcagttggtttgttcctttttgttcttaaatattagtaagttgtttttacattgatgaaattagccctttgctagatgagttgcaaatttatttctagttttttagttttgcttttaatattctttaagaagttttaattcttttatattcaaatttttaaatctacccacgtattttctagattttgattcatgcaaagaagtatccctgtaactctaaataacgtcatcaatattttctagtaattccatggggttttccatctttaatccatttaaaatttatttttgtaaagaaaaagataaaaatttctgaattgttttttctccctacatgatgagtcaaatggctcaacgttgctatttgaatgatttctattttcccataatttaaaatgctatttttgttataaactaaattgtcaaatgcatctgaatctatttccgacttttagaagtttattccatcaacatatttatttctagaatatttttaatgaatgcttccaattgtcagaaactaagattactttttacatctcatgaaaatgtaaatacataaagaaaaaactgtaaaccagacaagcgaatttttcagacccataatattgagatgagaatttgcttagtacttatttatgagctggtttggtatctattggcaaggcacaagcattttatttattggagggactgctcaagtattcccttccattaaaatgtgcatatatgcatacacatgaaaatataaaaataatgaaactgaaaatagacaaacattcatccattcatcttaggcataaaataagctcaggtttgagattctaccttctaaatttttgagaggttgaagggagggaagagggtctcactctgtcacccacgctggagtgcagtggcataatcatggctcacttcagccttgacctctcaggctcaggtgatcctcttacctcagcctcccaagtagctggtattataggtgtgcaccaccacacctggctaatactttttgttaaatttttcaatactattgtactgaaaggattaaagcagcaacgcagggttactccattattaaaacttgaagactaggaacacagcttactagtcaatgaagtccttgaaataatatgggaaaaaaagagaaaaaagaaataaactaaaataaaaagaaatagaaaatacagagccagtttattattatggcaaaaaaatcaagtaatttcatttacagataggtattcaaaaatagctcctcttgtggaacactgatattactgcttttcaaacatacaataaaacagagaaatgtgaatagatttctcataaaggattgttaacttgagtagtaaaattctcagtctcagaaaatcttgatgctttggttggaggcttgagtatttaaataatacctcctgcaaatggcaggtaatccaagtctagacaagctttgttttttaattgactgaattatatgcccaggatcaattaggtgctctctagattggtttctaattctgtgattcatttctaatcctaggaacccaggctacatctgatgaccactgacttataaaagggtaatttaccagggataaatagagtctactacatggcttaaaaaatcaattctctttaatgtgtatccctcagaacaaaggaagaaaaatatccatatgatgaatgcagctacatgtagctatttagtctttgaaatgtgactagtgcacccaaggagctaagcttcaaattatgtataattttaattaattataatttaaaatgtaaaactgataacaattattggaaaatgtttaggtatattttaaacaatgtttatatgtgattctactttttcagttgcaaagtttataaaatataggcaaagatcaaatacttttgataaaaacactttataaattgacatggcataacagtaaaaagcacaacagattttaaacacatagtataagaaacataatgcaaaatatctcaactacactgattacatattaaaatgatgatttttaaatatattgagctgtttctttttactgcttttagcctggatgctaagatactaagtcacactggtgcattatatttcttttgaacaatactgttctggatggttaatattcagttcttattcctagatttagaaaaaaatcactgaaaactgaagatcatcaaaaatatgccagtccttcataaaaatatcaaaaatttgtggatcaaaaaactctatcaacagagtgaaaaggaaacctgaagtatggggggaaatatttgcaaatcatatgtctagtaaaggattaatatccacaacataaaccacaactcctaagattcaacaataacaaaaaaacccaaacagcccaattcaaaaattaatatgggacttgaatagacatttctccaaaaaagatattcaaattaacaatgactccatgaaaagatgttcaacactactaatcacttgggaaatgcaaatcaaaattacaacgacatatcacctcacacccattaaaatggttactatcaaagtagaaaatttcaagtgtcaacaaggatgtggagaaaccattgtgtactgttggtgggaatgtaaaatggtacagttattgtgggaaacaacattatggttccacaaaaggttgaaaatagaactatcacatgaccttgctatttcacttctggatctatacccaatagaattgaaagtagagtctctaagagatatttgtataccatattcatagtagcattatttacaatagctaaaacatggaagcattccaggtgtccatgggtggatgaatggataagcaaaatgtggtaagttcatgcaatggaatgaaattccataatatgctacaacatggatgaaccctgagaacattatgctaaaagaaataagccagtaccaaaaggtattgtatgattctacttatatgaggtacttaagggtagtcaaaatcatagacccagagagtggaatgttggttttcaggaacacggggtagggaagaatgggaagttactgtttaatgacattagagtttcagttttaagagttgaaaagacttatggagaagtatggtagtgatggttgcacaatactatgaatgtatttaataccactgaactgtacacttaaaaatggttaagatgggccaggcacagtgactcacacctgtaatcccagtactttgggagaacgagatgggcggatcacaaggtcaggagacctagatcatcctggctaacacagtgaaaccctgtctctactaaaaatacaaaaaattagccgggcgtggtggtgggagcctgtagtcccagctactgaggctgaggcaggagaatggtgtgaacccaggaggcggagcttgcagtgagctgagatcacaccactgcactccagcctgaggacagagggagactccctctcaaaaaaaaaaaaaaatggttaagatggtaaattttatattatatgtattttaccacaataaaaacataagccagtctaaaaagtgaagaactaaaaaaatgtcatatattggctgatagaaggaatttagaattcctatgcttgaaaaagtcttatttggcttattataaaatcattgtcttactgtctttgaatatgtaaaatgctgtaatacagaaagacttatatgaaacctggaaagacttatactctgtcatgccaaaaggcaaactaggtcactgggtagaagtcatagaaggaagagcctaacaataacaagttattcaaaatataatataggcagccttaaaagggtgtgaactcccacttcctgggaaaatgaaaggtaaagggcacgtatgcatgtgaagtgaagctgattgatcttcaagggaccatccaaatcaaaggcactacaatcttgtcatttctttccaagtagcatgtattcctgtagactaatagattaacatgaggcaatatttcccagaatgtgttctgaagtacactagttccaagggaccctaatgtgtagtatgaacaggtattctctagtcaaaaagcttgggaaacaccgggtaacacaaaattaaacagtgtttttaaaaatttaattgcagaacttatcagaatcttcagtattttaatacacatggtggtctccaaaataggaatagtcagagttttcaaaatttatttggccatgtaccacattttttacaatctcctgaaattagaaaatgggggaatattctttgaaaatgctaaaacaaattatgcattaattaaatctataaaatttactttgtggaagagttgactggcaaactaaacttaaattcttgactttcttattcacatttgttccctcattcagcaaacattaacaaagcctatattatgttccataaattgtactagaaattcaaagacatttaccttgaagtcactcacagtctggtaagaaagcagacttgtaaaatgatggcggtaacccacgagaggggctgtaatggagctgagcaacgggtgaaggagagtcacaaaggtcctccatattcctgagttctgcatcagtggatttgatcaaaaatccgctgatcagatcaaaaactgcagatcaaaaatatgtggaggaaaaaaaaaaactctacaaagttccaaacagaagtttcacttgattttgattttgccacctgacgagtactatgttgaatccacacaaacgaagtgatgtgttagccatcttattaggtattataagtaatcgacacacgatttaaagtgtacaggagaatgtatgtagattagatgcaaacactacacctttttaatataagacttgagcatctgtggattttggtatctgtaggggtcctagaaccaatgccacatggatgtttaggaatagctgtatatatattatgtatgaagaagaggaactaaatgagtttttttgtggttgttatagcatcgcccttcaaaaatgttaaagtagtcgacagttacttgttaaactctaaaaatctatttgctaccaagtaaagtaaaaatatgtgaatgatccagttaaatatatctctgtatagagtcctaccagatgattcagaccacacaatgataattatccagaagtggttatgaactctggctttggagtcagacaaatatagatttaaatcttggttctgcacattctaactgtgggactgtgaaaaattagttaacttctccaaacctctattttcccaaatgtgaaggggtataacgatcccttcatgttaaggttgttgtaaggataaatgagagtatttataaactatttagcataatgcctggcacatggaatgcactagataatggcaattattattattgctagtttgtttggataattgctagaataattgtacaatctcagttttgtttgttctgtgtggacagagctttgtatgcgatgaaagctgacagatctaaaacagttaacactgaagaatataaagaaagaaggagaaaacttggatagagggtactgggtagtatagcatagtcttaaaaacacagttcggggctgggcatggtgactcatgcccataattgcagcactttgggaggccaaggtaagaggatcgcttgagaccaggagttcaagaccagcctggccaatatagtgagacctcatctctacgaaaaattttttttaaaaaaaactagccaggtgtggtgacatgtgcctgtagtcacagctacttggaaggctgaggtgggaggatcacttgagcccaggagttgaaggttgtagtgagctatgattgtaccactgcactctggcctgggcgacagagtgagaccttgtttctaaaaataaaaaataaaaataaaaacacagttcaatctgaaccttgttaattagctttaggacttggacaatttacctaatgtctacatcagttcccacacctataaaatggaggcaacaggactatctcttagagtagaacccgttgatggcattaaatgaggtaactcattgaaaggtcacagcacagagccagaaatatggtggacactcagcaagtgttagatgctgttattgttaatggaagatttgaggagcaagacaatcacaataataacatgtctagattgaggaaaggaaaaggaaattgtccccatagatcacatgcctgttcatatcatcttttatagatcacacatgaaaatcattccaactcacagcatggactactttgaaatgtaatcaaatattgttatggcattcactgcctggagaccaggcaagtcatgagggagtgacaaaataaggtgaaggaaaggtactctttgggtctgaacgatgtaccactagaagccgtatccccccctgcttgggattaaaatcccttgcagctgcgaatcccaaagagtctaatattttctgagactccactgtgcctttatattttaataccatgacatctggaatcctaaaagtctaatgtttaaccataaatatctgctgaaattaaagagctatataccaagcttcaatctttggggcctgtaattgcttgggaaaagagaatggtattttcccctctagctagaagaaaaagacctctgcaagcacagatattggcagacaaattttctaaccgtttcctctctccattctgtcctctcattttctccctccctctccaatctcccattttataataccatcttgctgtcattctcaggataaatgggaaaaaagagaagcctagaaaccttaaagaaaagacacatttcaaggtctagcaacaaaaagttgagaaactgcaagccactctctgttaagtagctgagcagacgtcaccacaatacctgagctttccccattattcagttagaaaccacttcatcactcagtgggctgacagtcaaatgccagctttattttcttttttttatcaacctaatcttttatttttgatttgaggccagtcacttttaaggtctccacagtggtttataactttctttcttgagaagtgtccaagaagtaacacaatttgaaaaatgttccctactgtctcatggtaaagaatgggaaactcacctgccctgaaggtgtatgtggtcagaaatcttggtcagaccacagtactttgctggaaataatgccaaggaaagtgtgggaaaagcttatcgtgagtttatatttttaatataactattctatgtggcatttaaaacatacacttagtatcaaacccatttttatccactgatatattatgaaagtgacattttgaggtcagtcacctcacttctaggaaaaatgatccatttaaaaagaggtttaatatgttgtttttattcaaataattaagattgtaaatattcctgaatctttttagctaatgttcttttctcttgtggaaatatattcagtgtgttcataagcaagtatgtttatatctgttggtatttggcacagagagctaattcttgattattcatgaaaatttgaaactatccactcactaaattaaaaatattgtcttcttaatatcttgtttatttacttcaaaaggaacatataactctatagtgatgattctcaagcctaacacagcagaatcacttattgtttgtgtgtgtgtgagtgtgtgtgtgtgtgtgtgtgtgtttaactcaaaggtctggactttacacacatctattgattcaaaatctccctacatgccaatgaatgtttaatgtcctagatgatcctaatgataagtcagttttagtagctagtgtcctgaccacatcataaaaaaatattggcaggagaatgaggggggtttgttttgttttaaaattttcagtctattgaagagtaataatttaaaaaaatacaaataatcagacaaattagatatacaaactataagccccacgtttacttattagactcaacagacataaaattactctgccaaattgctgtgtttctaagtggtaaatttctgtgaatacctcactgtagacaggtagccgatagtttgtgggccagcacgcgtggagcagctacctccaagccccacctgctccccttccacctgcacagcttcctggctgcactgcccgcctccagacagctagcgcactccaacacagctagcacaatcttttcagggagcaaggaaaatcctactgccacctttcttaaaatctcccaaaatatatagaaataggaaataaaactgtggttaacagagacaggggtttgggagtgagaggaaatgaggggatgttggtcaaaggacacagagttgcagatatgtaaggatatgtaaggcgaataagtccagaggtgtaattcacaacgtgaggaccctaggttaataatactgtgttgtagtcacgatttttgctaatactatgaattataggtgctcttgtcacaaaaagtaggggtggttaaccatgtgagatgatggatatgttcatttgcttcactatagtagtcattttactatgtgtaagagtatcaaaacatcatgctgtacatctgaaatgtacactaaataaataaattgaaataaaatccaaaccttttactctggccaagaaagaggctggctcctgtctatctgcaactgcttcttctctcaaaaactgcacacagtggtctcctttccacccacctctcacacatgctgaggcccttttggatctcagagtccctgccctggctgctccctctgcctggaagtctcctccctctgctcagggcaggcactcctcactccccattcaggtctcatttgaaatgcaactatttcaaatagcaattcgcctgcacacaagacacacacacacacagacaactcaaactacctttctagcccaaaacactattgtattttttccatccttctcatctctcctggaatgtgtgtgtgtgtgtgtatgtactttatatatatatattttttattttatatatacgtattttatatattttttatatattttaatatgtattttatatatatttatatatttttttacatatatataaaatacatacatacacacatataaaatatactcatgttatatacatacacatacacatatatatgtgtgcatgtgtatgtacatgtattatatatataatatatataattgttttagagacaggtctcactctgtcaaccaggctggagtgcagtggcgtcatcttggctcactgtaacccccgcctcccgggttcaagcgattttcatccctcagcctcctgagtagctgggatcacaggcatgtgccatcatacctggctaatttttctatttttagtagagacggattttcatcacattggccatgctggtctccaactcccaactttgggtgatctgcctgcctcagcctcccaaagtgctaggattataggcatgagccacagatcccagaatattttttatttggaattttgtttatgtacctctggaatttttatttgtttatgtacctaaccctactggaacataagtttgatggcagcagaaatgttgttttgctcattgctatagtttccatgcttagagacgctctggtagacagaaagtaggcaaaatacacttgccaaatgaatgaaaatgccaatttcagcgtgtagcataaaaaaggtgctcatgcaatgctagttttcattttacctcccttccacttttttttttgtcatggctgagaaattgttaaattctgttgaaactgaagctctgatttctttctgctgcctcctgacactgctggtgccccacatgtgtgaaccggggtgtgaggttatgccatccatttgtagtctgggacagacggaaactgagtttggagccagaatggaaagctttggtatctgcctaattctacctgaatgggacattaatttcaatgctttgttcttctaaatgattttgaatgttcagatcatcagatgcctccataatcaaaagaaatcctttcgagaataaaatgtaaatggttctcagaagatcacctgcttggcatgagctgtcttgctctctactgttatacatttttccaagttggctgcacatgcaaacttacagataagtataaatcaaaattagcagctctcttctcccctggctacacatcctgcattacacagatagcaaaacccactggcagagtgttcctcagagctgatccacatggatggtttttgctcctaatatgacaatatgctgggacctgtggatatctgtctgggtgagtagtttttgtacgaacttatatgtgcaaataaaatctgttattttccaaattaaaaataaacctcaaaggcaatggattccaaatgacttggagagatatgtttaaaaaaatatggaaaggatataagggtctgttaaactcaatgacatttggaataaatataaaattccagtggtctccatcttcaccttagctgcattgctttctctgatttactgaagatgataatagattcttgtcttgaactgaaaaaatacaaaatagtcattaattatcctaagattaaatctgtgcttttttcatccaacagactgtggacagtaactgcaaagtagctaagagaaaatggtttaataatgaaaagaaatttgcattaaggaagaagggatttactcatactttggaagtcaaagaaaaatactgcaatcctgtcagcacccggaaggcaccatttactatgtgctgtctctttcattgcaagaggacacagattgtatttttagtgcagtaaacagcagattccactgtgggaatccttgcagttggtacctatagcaacctcatttaaaatgttataaagctctaaaacatcaggggtttaggcaatcagtcatatatacctccatacagacattcagccactcacacacatacatgcttgtccacacactgatagtaaatcgtgtgtaatatgatattactcatggagttttaccattgaatcatgtttgacagccatggtaaagaactgagaaaaagcaaatattctaccattgcaaccagcagcaagaacatatttgtgcctaaatagcatattacaccatctggtaagcaaccacctaaaatgaacactcttatgattaaacatggagaatctgactgacattttagagtttctatttgtaagggatgcttttgatgccacacccatgtatttttggcactcaccttcatacaccaaaggctgctaccacaaaacctatgacttccttctgaaaaagctttttttcttttgataattttggtatcaatgtttttctcttttttttttccttctgagagtttttggtggcctcaaggaagagcacagttagcctgtgttcagagaaagccaaagggctggagagttaatgtccccaaagcatcccccaaagtcctgacagaaaagaaaggtaagctccaagacaggggagccaggatttgaaatattaacacatgagcttccctgtggcttggctgggataatttggggtgctgttcccatggtctcccgcagttccctatcagacttgagcgccagcttccacagtggtaaccagtttgataacacttcccttattggccttatttcttttcctaggatacttcctcattttcctactggtgttttataggatcgccccccattaaactacttggattctaagccttgtatcagggtctgcttctgggacaacccaaactaagacactatcttcagtctttattcccttctgttaggataaaatataattttcatcaaatactctggaacatacatcccttatggattccaaagaaatgggatcctcaccaaaagctcaagtccagaaaagtcccacaattaggcatgtgcttattttaacatatcagaatgttttccccatagcataaatacctgtaatggtggaataattcttaaaaccaatagaaaacttactatagaacaccatttgagtagatctaggggtaaataggagggtaaccccttatcttttcttcttttgctactttctttttagtgctacccacatattttctcagtataaatgtgtccctgaatttcattcttctgtgcaaaaaatatatttgctggttctattcaacaaatgcaaccaacacattaaaacgaacatttattcagcatttccatgcgcttggcactgactttaaaaccaatactgtagtccttacagcttttcactctattccagagataagccttcaacatatggaaaaacataaaataaatgttaaaaagtataaatattcaagcatgaaattttatggtaattaaaagaatcatatgtagaaacagctccaaatgtcaaatgctgtactgtagcagtagttcaggtgaaagaaaggtgaaaacaagtaaaaagatacatagaactgtctgcattttaggctttcatattacagataaattcttaaaccaatgacctgaaggcctcagttcattctgcatgctcttggatgacgtgtaacagcaaactcttctggctggttacttataatccattcatttgatcagtcaaccaaaatttattgagtaacccccaaatacacatcagtgaacaacaaaaaaaaaatcctgccctcatgaagtttgtgttctaaaaaggataaacagtacattaacataagcaattacatttataatataatgttaagtaccacgactctaacaaacaataaagcaagcacagtagagctacagaaaaatgatctcatgattattttagatagggtggtcaaggatggcttctctgagggtaccttatttgaacagcgggaactagctcccaaagaagtgagaataaaatattccaggaagaggaaaaagccagcacaaacgccctgatgtagtgatacacataccatgttaaacgaaaaataagagaccaggataagtaagtaaaaggcgtgtcacaagagaggaggtgagagagtgggcaggaaccaggggctacaagacttacaggcttgtagctgggacttcattctgaatgggtggaaagctgaaaatatccctctggccatgtgtgaagaatagactagagactacaaaagtagaagaaagaagaccagcaaggaggctattccctcatctagtgagagacaatggtggctagtagtaaagggaatggtgagggtggtagtagtggaggaaatgagaagtttgagaatttgggttaggaaaaagaaaaataaaagatgactcccaggttttttacttaaatagcctaatgaatggtggcaccaattactgaggtagggacagctaggcaagaagcaggttgtagattggggaagagatcaagaatctttttgaggcatattgagtctgagatgtctactatctttccaagtaaagtcagttggctatactagaccaaatttcagggtcgagtctaggctgaggatataaattggaagtcatcagcatttgatggtatttcagtcttggtcctggggagcaaaattagagaaagaaggaaaaaggtctcaggacatagtcctgtgaaagtcacacattcaaaaatttaaaaggacaagggagaccagaaaagaaatctaaaaagaatcaactaatgagatagggagaaaacagaaaaacttctttacatttgaccggagcaggttccagctgaacacaaatgagaattcagagtcagcttgttagtggaaataaaaagacaatgatctctccaggggtccagccataaaaattgacataaaagggtgctttgtttgcataagcaagaagaggaagaagtttggagcacagccttgtttgggggagagttggagaatggagaaaagggagacaaaacacatgacatctaccctaccattgagagagcgctttaagtcctgacagaaaagaaaggtaagcttaaagaaaaaggagctggttccatggcagaccagtatgaaacactgagcatgatggctgcttcaggcccaagtgcccaagctgggcgagaactgtcctcccagctgtgcactaagttgggcattgagaatctgcacttttgacatggacacaggcaatctcatagagggcacagcagtaaagttgtgagatcacataatgactcagcattcctgtaatacaggtgaattggcagcagattagcacagactccaactctagaatttaggtcttcaccagtacatttcattctcagtgagcacagcaaaaccagctccttcacaagcacccttgcctctaccacaggcattgcattcagatatagcttacctgcgttgaagaaggatgcagtccattctgcctctgttttaggaaatacagaaactggtggaggcagacccagggctctcccatccagatccttgaagagatattttcttggacttgcacagtctaattcaggacagactacttttcctaaatctttcctgtgaagacagtcaaaaagcaactctttcatttcatgataagcagcaagaagaaaatatacattggtagtgctaatgttgtttaaaataaattcaacagatttttattattgacaatgtgttacatagatataaaataaaactctttatgaaataatttatttcccaattatatggtcaagaagaaagacattcttactaaccaaatattttggatatcctaatatgtaatctttatatagattgctgattttttaagaagcaagatacaataaagtgttcctctcataacaactgaacataatataattatttttaggaatttcaggggtttgcagtattttagaattattataaatatcaattatatttatgctatatgcaaagaaaaatagatattctcattcaacaaatatctattgaaaacctacaaaagacaggctgggtaacatgatggtaataaagccaaacatggcactgcactttcagaatttagagtcaagtgggctatataaacaattaatagataattataatgttgacttacagagaacttattttatttcccctaatctaatgctttgaaataccattagtaataatattaaatatttattgtataccaacaatgtattgagtattatcagcacaaagattcagctgttaatatcacatagtactatgatttgaatgatggtcctttcaaatttcatgttgaaacttaatccttaatgaaacagtattaagaagtgtggcctttgggaagtgataaagctatgaggattcaattctcatgaataagatagtacccttataaaagggcttgaggatgaagagagtactctcttgcccttccatttcttctcctatgtgagaacacagcgtttctcccctctggaagatgcacgaacaaggcaccatcttggaaggagggagaaaccttcaccagacgcctattatgccagtgtttgatcttggactccccagcctccagaactataagaaataaatttatgtccaggtgcagtggttcagcctgtaatcccaaaactttgggaggctgaggcgggaggatcacttgagctcaggaggtcaaggctgcagttagccatgattgtgccactgcacttcaacctgggtgacacagtgagaccccatctccaaaaataaaataaataaatttctgttcttcataaattatccagtctgtggtactttgttatagcagcacaaacagactaagacatgtaacttaacagctatatcagcccgggataagacatgaacataaggaaaattggatagtaaattttaaaaagtgacaaaacaacacaaattgcctacctactcatgtttaggtacctaatcatgattcagggataggcatcaaaaagagactcgtgttaagccaaacacatgaatgttctaattagggtggcttctttagttttttgctttgtttttttttcttccaataaaggagtttgccccagtgttgtgggaaagaaaaagtaattcattcttcctgtttctaactttctactctctttcatggcataaaaaaatcctatctaattttcacatatttgaatgaaactcttagatcatatgtcagaaaacagtatttacacctggtctgaaataccaatatctgctagacctcatcgttcagttcagagattcctgtcagcagacacaatctccttctatctactagttcctgcacaaaaggctcccaaggtctccttctgaagaccactgacactttactccaatgaagaatgaagaattagagtcaatttattaccagcaagtttgaaaacatcccaaagaagtctctctaattaagacaaaacaataaaacaatatcaataaaacttgcacttcattacttctgcctctttcatcagctaaagaaaatcacatggctgagtccagattcaagggggagggaaatagcccctgcctctttagtgagagatattttaaaaatcatatatcacaaggcgtgaatataggaggggtaaagaattggtcattaagttaatgtaccttaccattctaagattcatttctatttctttgatgattttattcctttcaaaaaacatgtttagggtttgaagaattgccaagtacttcataaatatggcttattataaatactaaaaattatacctgggttgtaatgaaggaaagtagaacttgtttttatcttttatctttagcatcctggtcctctctgctgttattgggtgcataattccactgttctctgcatttggtagaatgcagacatccaggtcatcgctatagcaactcttcacaaaactagaaaaggtaacatctgaaattttaaaaatatgtatcataatattatatcatataaaccaccagccacaaatatcgaatatacaactaaatattgttataataatgtataccctaagttagttaaagctatccaggatagccttaggagtttacatacatcttgatataaaatatcagtagttcttcaatacatggacattgcatgcaacagagaagagtatttcaatacgttaaacctttaagagcaatatggcttttcatttgaggcttaatcaaaatccattcattttacagaaagacaaacccactgccagataaactaagtaacaggggagagactacaatggtggtacaagagatctaatagaagatgaactgcaccagtcgtgtcacaactttgattttaaccctcgttgctcaaccatctactaagcaacttcagatgagacacaacttctacatttcaatttcctcacttgtataataggaaaaataacacctaaccaagagagttcttatgtaatcaagttaaataattgctgtgttagccgggagtggtggcttatgcctgtaatcccaacactttgggaggctgagatgggaggactgcttgaggccaggagtttgagaccagcctggtcaagatagcaagatcccatctcattatattcaaattttttaaattttattaaaaaataatagttgttgtagaaagctcttcaatatgtataaagcagtgacttttgtaagaaattataaactaccattgtggctatcaatactcagcaggttggacagcaagcactagaccacaatgtacctttttgttgataaaatttcagaatgccattaaaaattttatgcatggatgtatgaaatggcactgcctagataaaataaaacatcctaccttgaagtttcatgattcctgaaattgaatgatcattcctcactttgtgccatggctcctgaggccactgatttggttctgaggtgaatacaggccacagaataccaattcgacctcctcttggattggagggagctctatctgttgatgtcaagttggctgagtgcggcttcactttgtcctgaatgcagtcaaaagaagagctggtggccacaatgactgaattcctaagcacaatctgcacttttttgacggaattttgtggagcagaaaatacatacactactgccaaaagaccaatagtattgtctaccagagtaatgttctctatctccacgctgttctctacatgtaacatggcaccatagtcaaagttcttgaaagccaagaagccagagattctggtacagttgtcaagtccactttccttatagagatgaaggccatgaagacttgaatgcgccacattgtcagaccaaagcagttcacaagaggagcacttgtggcctcggatgtgaaagccaagtctctctgatcctgccacaacgttgccatggaggttgatgtcctttacctggttcactttgattcccgccacccaaatggtggaccacgctggctgtgtcatcagaaccacaaggttattagtgacagtataggcctgaccctctaaatctatgccatggccagctgtgccaaacacaatattgtcatttaaaagtactccatgactggcagctgcatgaatgcccccgccacagctctggtgcagagtagatgatatgatccaggatcctgctgacacattactgaattcaacagatgagtacaatggtgacccgaagttctgaatttccacattaagaagttgaaggacacctataaacaaatgcatgtcatcaggtactttcctcttccccacaaaaggctgaagaatggcccattttggggcattaagatatgaacatttttaatgaaaatgtaagtttattctcaacaccaacattatatttcacaccatagattctcaactaaaaatgtaggaatcattacaagtatcacattaatgcctgaattgcatgtgcagtctgaagagtctggtgacaggacagggaaagatgagaggagaaataggaaagaggcaaactttggggatgggcatggccaagtttaacgattctgtgtatttgtcgggggccgggtcaaagaactgggtaagaatagattctgggtttctggcccttcacctcaaagtcaagtctccctctcagtgtctcagtgacaccacgtgaaaggccacagccattcccaagaagacactgcacaaatgaatattaagcatttctgaagaagagtatgagtgcgaaatttccttctgctcagttgatgtccagaagcctgatattccatacatgcttctgattaaaacatggtaggagcaataacatgcttttaaaatcactttaaagattctgtaaaatgttttctatatttttatcctgactacactttattcactgtttcatttttataagattttctatatcttttatgtgaggagaaaatagtgaattatttactctcatttgtagttttatttgtactgttttaaatagatattgttaaaacacactataaaatacacccagtaagttgatttaaaaatacaatgattcagcatacatacttttggtaaaattaataataacatgattatagatgaattaatatgcaataataatgaggtgaattaaatactttaactctcacataacactcattatttgcagacaccgttctaattcttattcatttatttattcatactcctaattttcaaaaaaatcctatgaggtaggtacaattattatccccattttacagataaggaaattgaggcagagaagagtgaactaacaaactaggacttaaacttaggcatatggatgagaagccgcactattaaccccatgcaggcatcctggaaagacagaaagactttgtggtacaaaagtagcatctctgcattatgattcagataactgccctatagctatgagccaataattagttgtgtgtcctttgctaggtaggtcacaactttggctccttttatttcatttttaaggtactgactaaagtaaactataaagttatttatctcattaaaaataaaggaagcaatacatttgaagtttctgtttcactgtttcaataatagtattaatagtatttaagtttcaaaggcagtacagcctaaacccctcatttctccactaccttttcagaaatgagaaactagaacccttgcaaatcggctgccatgaagaagcaagtccttttgagaaagacaggctaagtaaaggaacctatacgtctacttggggccaggcaacaggattccgaagtatctaaatttctcaatgggtgctattgaggaggcattcgtagatggtgtggacatattcacagaacaataaaacatccaaaagctatttcttgggcaatatccctcaccaatagcacatagctgaaagagctggcaaacctgcttcgtagaactttggcacaaagaacaccaaatgcaagcataagtccataaataaatagcttatttttagcatttaatgtgattttagaatctctgtcaaggcaacatgtcagtattattgttatttcctaggtttcttataaatgatattacaagggagataaataaagagatgtgtagggcacggcatgagggaagggcatgcagctcccattccctccccgggtgcgccaccttagtctaggaagctccacatgttcggctatccagaagctctcaggattattttaattatcagtttttttaatgtcttatgcttccatggatttgattcatagttttaaactgtacaaggtctttttactgctgtgcacattaaccaatgactgaaaattaatcaattagtaaagacttaaaatgtcttgagcattaaataaagaattaagcaattttttttgagatggagtttcactctgttacccacactggaatgcagtggcatgatctcagctcactgcaacctccatctccagggtgcaagtgatcctaccacctcagcctcccaagtagctgggactacaggtgcatgccaccatgcttggctaatttttatatttttagtagaggcagggtttcaccatgttggccaagctggtatcgaactcctgacctcaagtgacctgcccacttcagcctcccaaagtgctaggattaaaggcatgagccacagtgcccagcctgaatgaagcaattattttattcacaactattttcctatttttccttttgaaaatcactactgaaaaatatttcagcaagttaagtacaacttgctgggtattattcaggaagagaagaatgatggagccctccaatataaaagtaggactcaaaagtcttggcctgcttttctggtctataacaaatcagtacccatatctgccatccctgacctacacctgcagatcccttcttattcaggccctggactatgttatagaaaaatgtaagcattcttaatgcagggtataaacctgaattgaattctggaacagaaaaaaactgataaaatttgaagaaagtcttgagtttagttcatggtcatgtaccaatgttaatgtctttgttttgacaaatatactagtattatatcagctattaatggaagaaaattgagtgaaaggtatacaggatctctctatactacctttgcagcttttctataaatccaaaattattacaaaattaaaagtttaattaacaagaaccaggctcgaatctaccacttactacttgaatgactttccttactcttcattaatatttttcattcatatttattaagtacctaatgtacagcagttaccacactaggaaaacagatgaaagacctatttttcacctcaaggagtttataagctaatgaaggagctacataaataaataggcaattgtactatagactctatttcctgtaataggaatataaatttctcttatgaggattttaggattaaataagataaaattttcactgtatgaaaaccagcacagtttctggtccacaagaaacacaaaatagagtttctgtttcccttccccaggggatgatttaaggatcagcattgttagaagtttaggatcaggtcagtcttgctgctggttctgctctggcttggtgctcagctgtaagaactggccttctgtcctgttcctgtgaccatgctccagcttgccctgtggcttcagttaactgggggcttatcttgctctctccttcctgattccccatcttcctcaaccttagaatggggttcttaaaagaatggttcaattcttaaaagatttgaaccagcctttgtctccatcatctagagcagggttctcaacctcaacactattgacatttggagccagatactcctttcctatgggtggtcgtcctgtgcatgcaagatgtttggcactacccatacatgccagaagctccctcaagttgtgacaagtaaaaatgtctctagatattgccaaatatcacctggggtagcgggcagaaatcaccactgataacggcttatggagacagagcttgctctattaactagaaatcttaaatgtctgatttaaggtccaaacactgccctttacaaaactggtaaaatagttgtgccaacaaagagtgtcccatactgaatatatttgggaagtgtttagatcctttattctcggccttctccaggcctttatatattcatgtacaccacgattttataagttggagctacagtgacaaccaaactatttgatcaggaaagaactttggaataatgtataaggaacacaagtttaagaaacgaggtcctaatcaaataattttgcagcattccaaaagggctaaaacttgaaagaaacaagaaagattgaactgatccttaaagcagtctgaaatatggaaatcatttttatttaaatttacgctattaatttatagcatgaactgatgcctgccatcagatatagcatgctactgggaaagagtaacagaaattcaggaaagagataaaattgaagtggtcattaaatcatctataatttcaaagcagtggaaatttcacatctgctgaagatgttttctttgaggtaaaatgtgcatatgtgctgaccactagtatattattttaacatcacactgataattaagcacagattaggactgaaaattcatagcttctccaagcacaaaggaactatctcatttgaacattttgttttataaatgaaaattctcacagttgggatttctgggtgtcccagatgaataggctccaactggtaatggccaattacttaaaatttcatttacctgaaaattcttctcggctggacttcctgaaggaccccacaaacagtctccccctacatgatacgtcaggctgaatttgtatatttcgggtcaacagtccaacctcagcagccaaacgaatgtgtcggccatcctccgtgacatgtacacttcctggggcaataggagttgtgggaaaaaaaaactttaaaaacctgtttcaaaaatcactagctggggacccagcaaacctgagaaatgaaaacatcctttcccctcagaagttctaccaacattaaggtctgcttttcctggggcattctccacaaaggtcagctgagaaataaaataacccattcacttgtctctctttgggatcagagtcagagtgtttgagcaagaattcatttcttcttaataactgtgggtactggaacaggtcactggttcagggaagtcagggcagacctgtccaattagtggggtccccaacctgccttaaataggtcagcgtgagacttcagtgttgggttgtacattgtccgtggacctctttcatgagagtgaggagtcccacatcaactgaggcagtgacagagcaaaagcagctgtgtgtaaaaggaaagcgagaagcagcaccaggcagcagcagcgccctctcatggtggatcttccactcatcacggcctgaacagcttccacagcagtgggaactaagcgtcttgctagtttgtttcactgtctaccatttgcatttcaccttgcattttactgaaatcattgctgaagatttcttttttctttgccacttactaaaaaagaaatgctcctgggaacattgatttagacagagctttagatattcctggtgaaaccatggatttgcctctcaagtatcagagacaaaaagacattctccatcccctttatttccacagtttattactgattagctatatctcctggattagatttatttattagactgaatcaggaaggttattgtgatttattatttatatgtagtacattctaactgtgtattgtgtataaaaatatttggtaccttttttatttaaaaaaaggtctgggcttttttctttcattttttgcagtaatagtaatagtagtagttaatacataaaatgtacttcatgtcaggaaggacacatttctaagtatggaaaatgaaatcattatttacagtaactacaatattctaagggattataattcaatgtgtcaggaaataaactggaaactcagtgcccataagttttattctggcttagccagaaaactgcccagtgaccttgaacaagactctcaacccttctgctcttagatttgccattataaataaaaagcaaaatgtgtgtgcatgtgtatgtgtgtatgtgtataacatccaagtattctttaaaaataaagcaacaaaattaatgagggaatagagataaggccacgtagcatgagtctaggtcaacaggaaggcattgttcttcccctctgaatggcaatcagatccgaggtccccagctaggttaccaaacatggtcttcctagctcattcacttaccttaaccaacaaaccaaagccttaccaatatgccggtgtttgagccgttcatagatcctcacatggtggcccttgacttctttcacagtgaggacctctgcttcatgaggctcataagaagaggagctaaggactattttgtcatgggggcgccaatccactgcatcttctactataattctgtaacagcataacaatggcattggatatactaacagtgcagcacaaatcatctattaactccagagcaagaaaaggaaatccactgtgaccaacatatcccaccagagaaactgaaatagaaataagacatggcagtggaaaaaggctttcgcaaacagtttaatttagctaatggagtcagttttctggcttgaaaatgtatatgttacagagacagtgaagatattcgatgacccctgaaatacagcaaaggaataaaaaacaataaaagttccagaggttagtacacatgtctacatcagcaaccttctttctggattagggaacagattcaataataacagcatttcagaaaagaacttttctctaattttctagagaaatataatgccattttttgacaactttggacattttggacaacttttcatcatgtgttacaaatcctaccttcatgatgaaacagatacaagtgtgaatcgtagaggtgtcacttaccagctgtgtgaccttgagaagtcacttcactcctcggcttcatatcctcatctgaaaaggctatatttgtactttctgtcttctctttcatcacattatgaaacaatgagggttgtgttcatttttggtatttttcaagacacacatttaatacagtttctgttcagtctttcactgccgcctagcattccctctgaatatgactgttttattttcttcatagtcattaccaacttcaacaccataaatttaattgcctgcttcattagctaatgcccaaagtttagcaagctttgataaagagtctcctctatagtgaatgttcattcagacaacagtgtccatgtgcagggcattcaatcatgcaacctttattgaccgagcaaatcttatgcaccagacaatagagtagatgctagagacatacgataaataaaacatatgtcatttgtattaaaatacataacttaaattctgcctagcacatatctttaaagagtctactgtatgggtgtgtattacacagtattctgtgtaataccatgggagtacatattaataatacagatgtttaatatatagtattaagcccctaaaaggaaacataaattaaacctaatcatttgcaagccaatggcatgagtctaataaatgaaatattataattaattcacatctacgtacctaaggttggagaaagagtcatagagaagacaaaaaaactactatcaattgatgcaactttaatgaaggaatttagagtcttagctctgttcctgatttgctatgacttcctagaaaactcccagttacagaatatttaagcaccacaagctttgaaaggcaaggaaactaagttccaaatagatttaaataacaaaatgtaagactagataaatacatggagccagtgattgaattaggacaaaggaagactactgataaagtccagcattttttccactaaataatctcactttgcctgtcttatttttagttcttcaggtgctaaatggtattagaaaaagagtattcccacttttcataatctatgaaattataagaagtctatgatccatacaatggaatactgtatagccatttttaaagtattttgttgaagagcactgaattacaagaaattttgttcatgatgtattgatttcaaaaagcaggacgtaaaataatatgctccattttttaataaaatgatacatgcacagaaaataggaaagatgcatgttaaaatgttagcctacctatggatggtgggattattagtgattttcacttaaatctcaattttctaacttatcaggtagtatattgtagttagggaaaaaaaagtcaatctgctgtataattgaaattaatcctttacttcatagttagtatttctcagtagtccccaagctttttggcaccagggaccagttttgtgaagacaatttttccacaggggaggtggattcgggatgaaactgttctacctcagatcatcaagcattagattctcataaggagcatgcaacctagatccctcacatacacagttcacaatagagtttgcatttttatgagaatctaatgacccctaatcagacaggaggtggagcccaggcagtaatgctcccttgcccaccactcacttcctgctgtgcgtcctggttcccgataggctaaggatctgtactggtctgtggccctgggggttggggacccctgacctagacaatctttttattattatttatattgttgaataaagctcttcaaataataggtcactataatattctgagaagtttcatgtgaaagtgagattaaaactcatccacatgagattttttagggcaatattctgtgtaatactatgggagtacatatacacgatcacacatttgtaaaaatccatagaactgtttaacattgagtgaacactaatgcaaatttaaaactcataaagcttcattttctaacttccttatataagccatctgctccagccagatgaatcagttcactctcccctactttgctcttcaggtctctcattcttgaaaactgacacaagtcactacggtcactatgccttcaagaagtcttcaatgggagtctctttccactgaatgcccaaagcctccccactttctgtaccaccatcaatttgacataaaaaatgctgtttattgccttgtgactggttttgtattcttgtcttctgtgaccattcaacttttttattgttcattgatatttaataaaaataagactatataaggccaggtacagtgcctcttgccttataatcccagtactttgggaagccaagacaggaagatcacttgaacccaggagttcaagaccagtctgggcaactagagtgatcccatctctacaaaagtgaaaagaaaaaaaaaatgtagcctagcatgatgtcacacacctgtggtcccagctacttgggaggctgaggtgggaggatggcttaggcccctgaggttgaaattggagtgagctatgatcatgccactgtactccagcagcctgggcaacagaatgagaccctgccaaaagagagagagagagagagagagagagagagagagagagaaaacaaagcaaacaggaaaaaaatcactatctaaaccccatagcacctaacaatgttctaggaattattaaaattattagttcaaactttatattaaaaacataaataaacttaatctgaccttttctgttctggcttcccaaaccttatgagttcattaaaatgtatctttcctctatactcctgaagtctttcgggttctatacatcatgagaaccatacacagatgtcaaaggagcattgccccttccacgtctatgtccatatagcaacagtggtaacttcagaggaaactggggtctcagtatcaatagcctagttggttctgctagtcaaatgtcagttttccttaaattccaacatccactattcctagttccagtcttcaaacattatggttacccttcaatcatacgaactagcttaacgactggctcaaaatcccagctgtattctctgtattttattcctctgattagtatgactcctagatcttcagggaagaggggagacttgcttgttgttatgagcaaaacatacctcaaataataaataaacaaaaaattaaaagactttttttcaacataattgtacctaaatggaaaccatatgagaagagagaggaaattatgaataatcactgtggaagtctttttaaagataactctaagaaaatataaacaaaatatcagtacagtttctttattttggcataacttttgacctagttcagagaaaaataatatttactagacaaaaatataatacttattatttacagagaatttaaaaatgcttcaaaatttgatttaaaagtttttacaaaaatgtgtaagacattcacgtgtaaacacctacaacttaaatgaatttgttaacttaatacttgtaagatcttaatgataataactgcatttgaccacaggctcagagtgtacatatcacaaaacatgccctgtctcacctgcacctccaggaatagggatggccacagatttctgaactctactaatatttagtctttttcattttgtaacttcagtttaaaatttttctatcagtgccattaaaatgtaatgaggattctcagactgtattattctacacttgatagagaagaaattgaattctataatgatgctggtaaagatggtgagtgacaacaattatagctatagtcaataccaattatttgtctacctgacttcctctctgcttcattccaggaaatccctcacacctcatctgagaactgctcccatccactatactgaaatctgtgagagctgcaggttaaagtcccacaaacccttcaccaaaggctgggcataggatccaacctgcattcattcaccaaaatctttcccctggaattttgaatgaaactgaggggaattagtagtaacctcctcactggtggtatagctaggaaaagccaaacagatctgagttcacttgcaccatacagaatgaagaaaactattctccagtagaaaaaaaagaggttgaaataaagaagtaaaaaagtagaggaggagaggaagggcttgatacagtcttcaaaatggcttaagaagggttacttttacttgtactttcgacttaaagagccccgattgccacaatagctgccctgtcttaaggcttacactgtgccagaaactgggcttaacacctcatgtgcattaactccctcaatccttataactattctattagcaatgtattgttactcacataattaaagaaaataaaactgaggctcagagagagtaatttactcagagttacacctttagctaaccacctaactagaattagtctgcctgccctcaaagttcaaactccttttcattgcagaatatatttccaacctaccttccaaacatatgcctttcaccagcatcataatagtagtgaatttggcaatagaacccaatagtttattggacctctaacatatgaaaaaaaatcatcatcttttagaggttacatatgtgatcctgaactcttgccaatgagtgcataaggccaccaactctatattctaatacttaaactaagttgttataataataaagtttgaggaatgagcaaaataaattatagtagtatttgaaattaaattcaagattctctcatttgttagataatatgccattgaaccaagaagctcaataagttctgatttctagaaaatacacatcaagtcaatgtagcatgcatttattggagcccttctttatgttctgctgtgcactagacactaatataccaaatcaacaataacaaaaatatatctctcccctatagaagccacttggaggaacaggacacacaaatgttaaacatcttagtgttatgcttttcttaaaattacaaatcataaaatcacatcttacgttcagatgatgggaaaatttgtagagtcggagatacctaaagtcctgtgtctgatgtaatggaatctttaaggataaataggaagttatacagtcaaggaggagatgcaagaatactgcatctgatactcttatttcatttattaggtacttaaggagccagtacaaaagttgttgtagagagccatgggtgaagtgctgcaatgagaatgtagcagataggaaagaaaaaagaaacattccaaacaaaatatatacaaagaacacatcattaatttaacataggagataaaggaatagatataatcaattatgacattcaatttaaaggtttagggcctggagaaaaggatgaggtaacaaatgacttgatttcttattcagttcacagtttcttccttgtaaataacagagtatgttaataaatcacttcagacacctcatacctgtcaaaattaccaaaacagtgaaagataacaaaggttagtgaggatggaaagagaagagaacccttgcatactgttagtagaaatgtaaattagtacaaccgttatagaaaagagtttggagggtcctcaataattaaaaatagaatatgatccagcaatccatcttctagatatatattccaaggatatgaaatcagtatgtctgagatatttgcactcccatgttcacagcaacattattcgcaagagccaaaatatagagtcaatctaggtgcccatcgacaaatgaatggataaagaaaatgcagtatacacatacactctggaatactattcagcctttaaaaagaagaaaatctggtcattagcatcaacatagatgaacctggaagacactacgttaagtgaaatgatccaggcccaagaagacaaataccacatgatctcacttgcatgcagaatcaaaaagagtggaattcactggactagagagtagaatgcaggttaccagaggctgctggtttggctggtggtggggggaagcaaaggttgaagaaatgttgataaaagaatacaaaatctcagttagataggaagaataaattcaagagatctattgtgcaacatagtgactacagttattaatatattgtattctttaaaaatgctgagtgtggatgtgaagtatccttaccacaaaaaaagataactatatgagataatacatatgttaattatgtagatttagccaatccacaatgcaatacatgcatcaaaacatcatgttgtacagcataaatacataaaatttttacttgtcaattaaaaaataaaacgaaataagtcaatcacttgagaaagaaaggataacaggacaaagagactggatgtcttatatattttcttgaaaattcaatgagataagaaatgagaaaaaaataagaatttgggggaagtttcctcataatccagctcttctccctgttttccccttctcagtaaatggcagcgctccttacctagtttcttaggtcaaaaatttaagagtgatctttgactcttctctttctcttttcctcaatattcagtccatcaggagtcatgtcacttctgtcttcaacatatatttatccacatctttactcctccatcactgccatcctaatctaagccatcatcatgtgttacccaaaaaactgccatagcaatgtcttaacagttagtgtctctatttccactcttatctcttcctcatcaccaccaccaatagtcaattctccacacatcataaatcagattaaaatataagtcaggctctgtccatgtctcgtttaaaatcttccaatggccaagataaaacctaatctttatcataagattggttgacaaagtaaccatttaatttcaaagatcacatggctacccttcaaagactcacagcaaaagatatacataacatttgtaatgggtaaaagcaattttttgtgtctaaatctaacttgtcttgatttatttacaatccaaataaaacctcaacagttttgttcatcagtcttcacaagtcaactcaagcaagcaacaacagagagtaatttagagataaattgataaaacacagaataaaagaaaataatttttcttcaaaatatcttgctaagcttactttggttgattgtgtaagatacaagcttataaagttaacatgaaacttttcctccgaagttttcacactaccattattcacatatatatatatatatattttcaggtatcaaattcttttggtgaaaattcatgaaacagttcatctgaaatatgcttatatcacaatatattagaaagacaaagacttattgaattgacttttaagattgtagagccatgtttaaaaaggtggcctaaataaggtctgtagctcagttaataccgtaccaatatcaacttgccagatttgctaatgttctatagttatgtaatatgctatcatcagggaacactgagtgaagggtatatgtaaactactatttttgcaacttattttgagtctgaagttatttttaacattttaaaaaaggttttaaagagaaagaattccataaaatgaatatactacattaattgcacatcatttgtataaactcattaaattatttctcctcaggactgatactaagaaactttgtttttaatatttgtaatatgtagaacacacgcaatggaatcagacaaatcagggtgaaaaatccagcctcaggaatttctagctttatgaacttggaacatttacttaacttctccagcctcagttttcatatccataaaatgcagataataatacctaacttatagcattgaaagatttaaatgagataatgtatgtaaaatgcttagtagaggcctgacatataacaagcttacatgataagaaccaaataaatggtagctagttaatgactatggatagttttaattaataaaattgagttcctttcaaaatagcctgtagctcagactccaaatgaggtttttaacacattcttataagaaaaatccattcatatggttcctgccaaattccagcttgctaaccttttaattataattaaagtttcttattgatccttgttagaaatgcttacttcacaaatccttttgaatatcagaaaagcactttaaattcaacatgacctaatctgaattcataatcttttctctaaacttagtcctcctcaagtgaatgacaccactatccagctacacaaaccagaaaccaagaatgcacttcatattcaatgtgtcttatagggtttatctcctgcctttaaatctgcccacttctccattgctcctgcagcccctgactacaattacactgtctcttgctgggtgtctctggatctactatcaagctctcctgctgtctacattctgcctacaatattttagatgtacaagtatgataataagtgttacctcctatccatactacccccttaaaaacctacaacagcttcacaatgctcttagggtaaaaactaaaattcttttttttttttttattatactttaagttttagggtacatgtgcacattgtgcaggttagttacatatgtatacatgtgccatgctggtgcgctgcacccactaactcatcatctagcattaggtatatctcccaatgctatccctcccccctccccccaccccaccacagtccccagagtgtgatattccccttcctgtgtccacgtgtactcatctgacagagggctaatatccagaatctacaataaactcaaacaaatttacaagaaaaaaataaacaacccaatcaaaaagtgggcgaaagacatgaacagacacttctcaaaagaagacatttatgcagccaaaaaacacatgaaaaaatgctcatcatcaccagccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaaaattcttgatattgccaatgtatgtggccctgacacttaaccaactccttggaaccctgtcatgatcagcccctactctccacatcaaccatcatggtattctttcagaccctcatgttctccattctccctcccaaccacagaatcacgtctccaccctctgcttctcaatcacctgtgttgactcctcaatatctaaaaagttagaatgcccccaatctcaatcccatgctccaaatctctcttctacccatgtcttcttcaataatgacatcacctacttccaagatggctgcttccaagccctaaattatgcatctgattttcttcttggcatctactcttggtgtctccaacttcgcatgcccctgctgccttccaccctgacaaacctattcccctctcagtcttcccaactcagtgcgtgcttcctccattcatcagtgtgctccatcaaaacacctgcagcactctttccttgcctccacatgcagtcatcaggaggaccagttgttctctccatctccactgcctcttccagagtcccagatacatgatttctggcctcaactggcctcctaactgatatcccagctctactgttatctccacaatccatcatctacacagccagagaagttttttaaacaaaaatcagattccaccatcctcctgcataaaacccttcagtgatttcccctttgacctcttatacctgaacaaggtcctgtatgacttggcacttgccatatcagacaatgctgccctctgctcactctgcgccagctatagtgaccttcttcctgtttcccccctacccccaccctaggccagctggttcccacccatccttcaggtataagctcaaatttctcatcctcaaagagactttccctgtccattcaatctaaaatggtacccttcacattttctgccccagctatttttgatcatatcaccatattgacttccttaccagcatattttataatctcaaccacgtcatttatatttctgtatttgtttgagtatcgtctttctctcaactaagatctgagctcccagagggcagcaatctcttctaatttgcaatctcttctatatgtctagtgcttacagtctgacctggcacatagtaaatattcctcagatatttgcttaataattgaatgctgtttgctctggctagaacaccgtttccacatataacccactttgcttaattaatgtccatgcttctttcagatcccacctctgaaattatgcttcagggaagccttctccaacttcccataaatgcctcaagttgacatattcatgttttcagaatcctacataacccgccccttcacagaatttatcatgtatgtaattttacatttactatttgattaacgtttgagtttttacttaatattatatctccagatcatagctcaatgtttgacaaacataagcatttgtgaaaatcatgtcaaataaataattttaaataaccatgaacataatacctactctacaaagaaattctgtacatagagaaaagcacaccaaagcatacctatcaagatagctacctatcatttcaccaacagggatccttgctgtgctgtatgtccttccagggatttccctattatgtatatgcatacatatttttatttctttatctacaaaactaggctagtatgtaagattaattcccatgtgaatgtgagcctctgctctattttgtcaacttggaattcactattttccatctttgccaaattaaaatttaaaaatggtattccattactgttttaattaatattcaattctagtaaagatgaccattttttctatatgtttattagcaagatgtattttttttgtggcttacatattcaaaccctttcacaaatatgtttctggtgtattcatatttttattttcattcttgacatataaaaaatattagtccttcatctgtactattgtatgctgcaaatattttctttttttttaattttgttattattatactttaagttttagggtacatgtgcacagggagggatagcattaggaaatatacctaatgctaaatgacgagttaatgggtgcaaacattttctagttgatcatttgtcatcacattttgtaactgacatgcagaaatattgaccttgttatattgtcaaatctattatttactgctgtggctattgttttgcttgttatgatcagagcagtctttactgctttaaattacatgtttacttaaattttcttcaaataattttatggttttaacttttttacattttgttttctaatccacctataatttagagtaaaacataaagtgggaatctaattttatatttttctaaaggatttactaattattccagcctgtcttcaactaaattcaaatgctaatttattcaaattctaaaaataatgcatgactgtgtttatttcttggtattctttttagttttggtgccaacaacagattactcatattagaggcatacatttaaaaaaaaatgctaatgtttggctattttctcttttttttggccttttattatatttagttacatttgatttatcatattttggtgtccctcagtatgttcctcttattcttttcttttattttattattattatacttcaagttttagggtacatgtgcacaacgtgcaggtttgttacatatgtatacatgtgccatgttggtatgctgcacccattaactcgtcatttagctatccctccccgctcccctcaccccacaacagtccccagagtgtgatgttccccttcctgtgtccatgtgttctcattgttcaattcccacctatgagtgagaacatgcagtgtttggttttgtgtccttgtgatagtttgatgagaatgatggtttccagtttcatccatgtccctacaaaggacatgaactcatcattttttatggcagcatagtattccatggtgtatatgtgccacgttttcttaatccagactatcgttgttggacatttaggttggttccaagtctttgctattgtgaatagtgccgcaattaacatatgtgtgcatgtgtctttatagcagcatgatttataatcctttgattatatacccagtaatgggatggctggatcaaatggtatttctagttctagatccccaaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtcagttcatatgcttcacctactttttgagggggttgttttttttttcttgaaaatttgtttgagttcattgtagattctggatattagccctttgtcagatgagtaatgtttggctattttcaagtgtttattattccaaagaatttaatgagtcagattctgatgcatacattagacctgtgattcaagttgtattagatttgacatctttaaaatagtgaaccatcaaatttttgttatgcatcaccatttattctgaactctttttatgccattgaatagtgttttatagttttgtttttataggttctgtaatttttcctaaatttacttctagatatttgcagttgaaattttaaataagcttgtacattataatttaaaagtttactacttgtatattaaaaagatgttgatgtgcatttattgaaggcaactgagagtttttcagataattctctagttttataggatgaaatatccattttataaaccacataaaaagatagtttggattattttcaataattggatctaatgtatttttcttgcctgaatatattggctaaaactttaataataatatttaatgattgttgtaacaaacgataatatttaatgtcggtttttctcctaaaatacaaaactgtttgagaggaatcctttaatgtttattttgtattattacttaaaccagtgcttctcaactaatggttataccatccaaataaatagcattaatttaaaagaagtatccttgtagtcttcatttactgtttattccaagaatgtttgctgaattttattaaacatatttcctttttgtgccaaattggtcatgttcttaatcttcacatctggtattaaggtaaattatatgaatggattatttcatttcaaattatctttgttcacttgaatgaaacacattcaaacatagcttgctttgtttgttgcttttttatttatgattttttacattctatttggatgttttctcagttttcttttttgagttattttagtagctataaacaagtgtaaagattattttaggcctgttcccttaaattaactgggaatagattatataacataggaattatttgatattcaactgattggaagaacatggtataaatttatgtgagccaaatgtatttttggagataaatctttgataaatttatatctttcactattccttgttctttgttttattcttctctagccaattatgataattctaaattatcgttaaaaattcctttttataaagtatttttctcagaaatgttaaagttgcactatatagatttatattttttacattataactctaaactattctgtacttacatttgaactgtcatttctcattttatatattggggttttcttggtatgattaaagttattagagattaaaccactacctctttttaaaaatttaatcttactaattttctactttctatttcaccaatttctgcctttttcttgcattgattgagttcattagacttatgggttattttgtttctaatttctcatattgacagttaatcttctttgtttagaagaattttttgtttagaataactgtcaatatgaaaactgtcaataagaaaagtttgtttgcttattcaatcatgaaagtatttaatgtgatgacatgttctataatatctcgtacgctatattctcattattgttacttcccagctattctgttggtaaagttttgatattttcttggatataaaagttatttagaagataatttattataccttttttcttgtaagaaattaagattgttggtttatattttattttaatctccatgtttattatattgtgatcacatattattattaaaatttattaaggtaattatggatatatattttttagggtaaaggagtagtttgatacataaattaaattgcttttattatattattcatgttcttcttgttttctttaccttttttaacctaattaaaagatttggaactgaaagagataaatacgtgtcttagatcgtgatttttgtttctgtcaatttcaccttacatttcctagagatttgctttatatttctatattgtattatctgctgtaaaacttttctgactgttagtgttttgctatgattgaaggctttactaatgtaaattataattatttaaccaatttgaaacatttattttgatttttacctgttttgttaataattttgaggctcctttattttgttttagatgtcaatgatttattcttatccaatatttaactttaaatttctcctagttggttttaagttttcctctggtaaaaaagttataattatattttgacttttaacccaatttttctatatagcattatttttaacaaatattttgtttctgtaactggcaaatttgtacttactttcttatttctgtttgttttaaatataccttttttgttgcttttattcttttaccatttcattttctttttttttctattttattatttattttatggtttctttcatttttttcccactggtgatttggaaagtatatatgctattcaaaattctagtaaaacaaattaactcatatttacctcctatggctatagttccagatttttatctgataattttgaatggtgaagattcatttatgtgtcatatttgctaagctattatacacagttactcaatcaaacactaatctaggtgttactgtgaaggtattttgtcaatgtggttaacacagttgagtttaaggagattaggccacccaataatgtgggtgggcctcatcaatcagccagaagaccttaaaagcaaaagtgagatttctttggggaagaagaaattctgccttaagacggcaaaccagttcttccgtactttacaacatactggcctgcttacagatttcaaactctccagctcccataattgtgtaaatctatcccttgaaatacatctctttatatataaatgtatgtatattaatatttactatacctattgtataatttacatacatataacaggtaggatacacacacacacacacacacacacatgcacataacctactgattatgtattttttgtataaagagaactccaactaatacattaacttttcaagtgttatgtcatttcttttacaagaacaattattagaatttgttttaggccaggcacggtggctcatgcctgtaatcccaggcctttgggaggccaagacgggtggatcacctgaggtcaggagttcaacaccagcctgactgacatggtgaaacatctctactaaaagtacaaaaattagctgggcatggtggtgtgtgcctgtaatcccagctacttgggaggctgagacaggaaaatcacttgaacccaggaggtggagatcgcaatgagccaagattgtgccattgcaatccatcctggccaatagagtgagactgtgtcaaaaaaaaaaaaaggaatttgttttgttttaataaccatagttacactataatatttaaattatttcagtgcttcttagttatttatattattctcaaattttatttctgttcccaaattttaagtttagtttaatctctttatttgaacactgaattttcttccattttccacatgagcgtcttagcagtgtgtccaattctttggtcacaatatttttttccttaaacatttatagatgtggcatcacgatcttcccacatgtgatggtgtagaggtgaatgctaaggctagaaagcttgatgttcctttcctttactttttgttcactctatttttcttatactatgaagataatgtaataaagcaatcaccatccttgatattaatcttttctaataaaatgtaactattcccatattttctatgtgtatttcagttatagtgttcattattctttctgttgtagttattctgagttcttactaaaaagacatatgacccatagatagcttttaattttctgatctctatttctagtactttatcttttgttatttttatttcctagtcttatcctctgtgtttggataggtctccatcagtttgttcttcattttacctattctttgaggaagcaatgactctgttctttactgcctccaatgcattattaaatttcacaatatacttcatatgtttcatctccctcctattttatttctgtctatatcttaatgaggtaccttttcagcttagacatagtattcttacctcatacttcatctcttatctcatggaattcatatattttaagattttatggacagcaataattatgtattatctaaaattttctcctgaaataaactgtgttcctctattaccttttgcatgttttgttctccttctgttatgttatagagatattttttaaattccctataatcgcttatttttctacttgctcatcctttaattataatgtttaacctaaaaatcagtttcatattgtaacaaaatctcaagcagaagcaacctaaacaacaaccaagaaaaagccctaagttactctcattccttacctctcatttcctgaggcaatatcagctccaagatgtgtccaggagttcttaggataagcactgtaaagatgaactttcccataaacccctgaaaataaaaggagtaacagttggatagaaaaatccttcagaggaatgaaagccaggtaagtaaaagtcattccagaggctgttgtgcaaaacatgtgatatagaatctctatatgaaggtcccatattatcaaaagcattatttaaatgctctattttacaatactaagatatatctcacatggctatgaaatttattctctcaaatgctatagaaaaaagaatgctacaccacatcacaataatctaaaaggtgggaaaatagaccactctaatgactaaagttgaagaggtactcctttccactcttacgtgactccaaaccatttgcaattcttttggaagttaaccagttttgatattttttgttacacactaggttctccaaaagcatggttaactctatttccttaggatagagttttggagctattagctttatgtttagtggctggacttaatattttgtcttataaatatcaagggagagatttctaagtcctttgtttcaaaatgcagtttatttcagactaataaattaaaggcttaggagaaatgtgcttgatacagctcagttttattttttcatgtctttcttcctatatgttttattgccattttcaatcataattcctcatattctagtggtttaaaatgttttgaccatgaacctcaccagaaaaagaaaaaacatgtgattgtgtactctcagcacatatatatttattttatttagataactcagatatttatatttagataaaaaatatacacatatatgaatatactaatatatattggaatagaagttctaatattttattcctgcacccaaatgtattgtctgcatatccctggattgatgcactgtattttattgcaagtcattaatctaaaaatttaaaaattttacaattttcatcagaaaacatagaaataaaagaagcaggagaccactaaggtacaaataatatgactttggtgttcatctgataaggaccaaaaaaaaaataatcccaattaattagaacttaaccaactgtttatatcaacatccacattttttccatatatcaactatgaaaatgtcagaagataagaaaactaaatcaggataaatggatataaaaagaaccccattttcaggacgtgtcctgaaaccaatctttcataatagcatttatatatttcataagacatcatcatctaaaaccaaaatccatcttttttcactataggctaagtaagctaggctgagaaggatcctgaagtaatttaaagagattttcaaccaaagcatttataacaaaaagcagttcatgtccttaaatttgaattatccagaaaattcaattgaccagaaaagcagatttcttggtcatttccaatcatcaaaggtttactgtaaaatgacaccatttcttagttgtttcaagaagattacaaatgatttaatacgattaaaatttgtcatctacttatgatactacaaaaatttgagcatgcagtaaaagaaatacttcattctttatttcaatttagtatcaaagaaaatttcaaagacactagtttgaccgtacagccaggatcggggatcagagcaggcatctgtggatagtcctaacagaaagtttgttccagtgttatcacgctacagaaaagagtgaataccacaggcaaaagaagatcaaatattcttataataatccatctagtttgtcaacttagaaaaattaaaacattcttgaacctcttgttattagaaagataaaataaatagcatgcatggaaaaaacctttggaaacttaaagtgctatcaaagtgttatatgacaatagttatatattatggaactaagttaagaaacttcatactagcttaacattattgcctccactctattgagtactgagatccagagagggagccattgactgctaatgaatattaaatttatatctcatagtgttcagaaacctcagaaatgatggtccttgctctttttccacaaggaaaaatgacttacttgaaaacctccaacacagcaatgcatctaagggagaatccaagaaaattaacaaccaattttctttaaaaatgttcatattttttcttttagttaatttttttctcacttatataatagttgaaataagttcactatattttattattcttttagatattgtattgtcacatagcttaaatatgataacatatttattattcttttagctattgtattgtcacacagcttaaatataataacatatttttaaatataataacatttaagctgtgtgacaatacaatagctaaaagagtaataaagtatagtgaacttatttcaactattatataagtaagggaaaaataaccaaaaaaatgaacattcttgaagaaaattgcttcatgccaagagttatccctctttacttataaaattagtaatgcccatatagaaaaagtgagaaaatactttaaatctgatgaacattctcttatgcctcaaaactgagttagttggggatacatacatatggttatacaaggccagtccccgtttctgtacttttacatagaccaatttaaaatagcatttggtattgtggcaatagcaaataaagaaattgtcaacagtgaatgttccttattaatttatagatctatcagttgtataaatgtatcaataatcgagtagtatttatagttgataatattgactcagtcgaaactttagtgtctgactaatctggatcttaatccataatgctgacactataaagctgtgtggttttctgcatgtcgttcatcatctctgagtcttagttttgacatctctaaaatggacactactcacaagagagctggtaagtgaaataataaatataaattgcctaaaagggtgtttggaatttagcatatgttctatgaatagtatttctctatcagacacaagcacacaatacacacacatgcattttatttttaataaaaactatattatactcttaccaattgttcctgggtcaatatgaattccattcatacggtcacaaaagactccctctgaggctctaaggagaatcagaagcttttgttccttttctaagggattttctaaagtacctgtttacaaagaaaagtatatcattcaaatcaatttgaaattaaaagaaagagagggagaaattgcagtataatttcaataatgcaatgtagatactgtgaagtagactatatggaggagtcaatggtcatgcagatgaaataagagtaggataaaaaagattcagtaaacttctttgaaggagactcatgtattattcaccaggtattcactcttctttctttattagggcagtgtaaactttcctgacctactaatatttatcctggtcatatgacttgctttgaccaatgaaatttgtgtgaaagtggtaggaatattagttttcagttgatgctttaagggacttggcaagttgttttgttttgttttatttcattttttaccagatctctttcaatgttgttctctaccatgaatacagaatttcttaaatagcctgtggtatctgaatgaagagatatgcagagcaaacctgaatagaatgcacaagctggagccaagttcaactaagtctaacacaaatatttcttgatgtaaaccactgagatttggggattgttacacaccattattatggcaaaacctgcctgatacactgtctatggctagataaccttcaaatctctttatatgcattttagcatttactcctcacaacaaacctgagaagtcagtataattattatcccagttttaaatatttgcacataaagaggcttacaggttaagggacttgtctaaattgatccaactattaagtaacagaatctatttgaacacagatctgtttatgctaagtgtttatttaacagataagaggttattttctaaaactaaattcttttagcagcataaagactcataaagacataaggctatgatactcagacagcagttggaattctttctgacctaattttattgatgttaacagtggagtttggtatgaaaattcatacttctatggtatgagaattgttcagggaatttgtcaaattagcgttagtgagtatggacctgaggaaggttagtttcaatggaacatatgtcttagagtacaaaaatactaaagttattaaagtcagttgtttgagaagtaactggtgggaaggtaatcccaaaattatattccaaatcagacaggttaataaaaaccaccggctatcaaatgcgacttcccagtatataaattcccgaaaagataaccaaaaatgacattgctaaatacaatgtgaaataactagtaaacttacaattgcctggttttcatcttggttgctggtcttttgagcaacataaaatcatccccccttgctgacacttcctatatacctggatagccaaaaggcacaaggtaagtctaaagcttgctacatacctatttttatagttcagccttcacagccattactctagtactctgctgaaagcaagcaagattcagacaggtaagtaaatctgcctagaggcatatagtaggtcaatgggtgagcaagcctatgtatttccaataatatgcaaaggtgtgttgctcctctgtgtaggtaatgccactcctcagctgagagcctgatgcatcatcttagtgaaaataaagatgtgctagagcagaaagaagggaagcaggggaggatgaaaatgtttagtaaatgtgtatggcgtagctgttatcttgccattacaagtctgtccagtaagctgttttccaactgtgatttcatttatttcacggagggtagtttagagtctttgggaaaaaaaaaaaaaaaaaaaaaaaaaaaaaaaaaagtggcctagcactaaagagataccagagagaaaaaagtaggacagtttttgccctagagaaatgtatgcagagtcccacaaaaagagttcagcgttcctctaaaattagagattaaatcaattatgcaacccaacactgcagcacatgtggagctttcgcagaaagtctgggcaaaattagttagcctgccgtgatattttgctatctgcaatggccagaatttggcttcctttttgtaactgagagaaaacgaaagatgaagaatagggactaagtacaaagaaggcaaaggtgacctaagagaaggaaatacatgctattgcaacataaaaatgaaatgcttcttgaatgtgtaaaagctgataaatggaaagctttaaaggctgagatcctcattttcttctcaatctagcaatcaaagaaaggtgaggtgctctctccagcgtggactttgcccctaaatgagggtagccacctctgagacagaagatgctcaggatacgcagctcatccttggtttacctttgtaaagcttctctaaactatactaagaggcatattaaacctgggcaaatttatgtattcataatgggaggaaaaataattgtcattgtgctgcaaagacattccggatattttcacatgcacaatttaattctcacaattttatgatgaatacagttgaggttctgatgaggaaactgaggcaaagagaggttaagtagcttgtcaggaatcacacagctgttaaatggcgaagttgggccttagacttaataagtaccatcctaggacgtgtggatatggaggaatagaaaagaagtaaagggaagcaggcattacttagtatgatggtgggcagtgaaggggaaacaatgtgttccagatgctaaaatcacctggagagatggtagaaaatgagttctggcatatgaaagataatcattataattatttggggaatatggtacaaatgggttccaggaacttcaaaaggtaagaataagaaaaaaaggcatttcattattttattaactaaagctctttgatggaatcaagtataatcctagtttgcacttaagcccactctgtcaacatgactcaccagaccttgtaccaagccaacccgtaagaaattatttacccttccttcaactcactctcctctgtgctcatgagatttcccagcatttatgttttaccttcatcttaactaactctgattcatccctcaaaacttggctccaccgtaatttattcctaaaagccttctatgatcttgaattagatgtccccttttgtgtgtaaaatcttctgtaccccttgctaaagtaattctacttcaagaaacttgtcctcaagaactagtaggggacaaggacaaagaataatgctcaaagttctccactgcagtgttatttatttataattggcaacatttaaaaacaccttgaaatagcaaacaattagaaatatttttgtccattttaaactccttcctttcttcccagactttttgacacacttaatagctgaaacatacaagtccccaagcaaccatatactcccttgcctctgcccccctctgccttcattcctgtttttgtcacggccaactcttacatactttcaaacccagttcagatgccacctcttctggaaatgcccttgtcaactaagtctgggttaagtgaccttctaagggctatcacagaatgccatgttttgctacaatacttctaaaactatactgtaagggccatttacctgattgcctccttctctcagtgagcgcaagaagaaactatgtattcccagcagagtttatttgaagatattttattccagaaatgtttaacttggtaatttttaccaaccctcctggagaaaacaattggaataaagaaaaataccccctagtaataaaagactaatttcaccagtaaattacaacttttaagcatttatgtacctaccattatagcttaaaaatatatactgcaaaaatcaacagaactacaaggacaaatggatatacctataatacttgtagtaaagccaacacaactgttgctaaaaaaaaaaatacaataatgatacagcagttttgaataatgcaatttgcatatttgacataacaggcatagatggaaaactagacccacaaagaatgcgcattcttttaaaccttgcacaagacatttaaaaaaactgatcatatgatgatgataaagcagtttaacaaatttttaaaaattggaattatacagcatttgttttctgactatagttccatcaaaatttacaattcataataaaaaaatttcaaaagtgagctatattaaagatctttccaattatcaaagaataccattaagaaagtaaaaaagcagccagatgtggtggctcattcctgtaatcccagcactctgggaggccgaggcaggcagatcacaaggtcaagagatctagaccattctggccaacatggtgaaaccttgtctctactaaaaatacaaaaattagcttggcgtggtgcgacgcacctgtagtctcagctactcaagaggctgaggcaggagaatagcttgaatcccagttgcggaggttgcagtgagccgagatcgcaccacactgcactccagcctggtgacagagaaagactccatctcaaagaaaaaaaaaaaagaaagtaaaaaagcaagccacagagtgggaaaagacatttgtactacttataaccaacacaagatacattccaaaatatataaatgactttgataaatcaatataaaacaggtacattcatcattaaaaaagagtaagagaacagctatttcacaaaacaagatactctcaaataaataataaatacattctactatgctcaatcatatcataaaaaagaaataaaaattaaaacaagaatgagatctcactacatatccagtagactggatttataatgtttaattaagcatatatttttcattttataaaatttgttgtatatgtgtgtcattttccacaattaataaaaatatgttaaatgactatgttccgagaatactcttcaatgagttttgttgatcaaaagaggggaaactggccaaaattttagtcacatcttctgaatatactattttccaggtgctagtcactgaatccaaagcaacaaattgtatttttatataatttgtatttttatctgagttaatcttaaaactctataaatatcacgactgcacatgaaagataaagaaattacccccaaaataaatttcgtacatttttcccttgtcctcagaagtgggttaaatggtgtttactttggaagttgagcttctacccaaagcataaccatttttctcatgccctgcaatagcaattttctgaagaccagagcctctagaaccttcttactatcatataaacccaagctggtaaatagcactcaaccaagtaaattgcagcacatatttttttctgaattagcttttaattcccagtgtatatttgactcgcttattcctaaaacattcctctccagtagaactgattccatctgaaaataaatgtagggtagaatggggcttgcagtccagtaagataaaaattggttataaaaatcagtaggcattatcaaattataatgtccaacccctcataaagtgattttattcaggctaacaaattttcatttttaatgaggcctctcaatttttcaattaatggaatattaaaataaacatgaaaatatgttattcattcactacttgcaaaatgtacaaaaattctgaaaacttcctccataaggtcgagcaaattacctcatttctttaagcctcagcttcctcaatgataaaataggcacaataatagcatccattttttgtgaggttaaatgatttagtccatgctaatagtatatggcacagtgtctgtacataatacatgtttttaaaaaatgttggctcttagcaatattaataatagtagttaaaaaaacagtaatagtaaccatggaggtatcacacttatttaaaattaacctttaaatttgaaaacttaaaaaaataaggcaagctcttcctagcaagtaatatctaattcctaaagtactagctagacactagacatttcaaagcaaaaatattaagtgactacttatttcaatggccagcccaaggaacttcagaaaacacaaagtttaccttaaactgaaacattcctgtaagttttctaactaaaaaaaaaaatcattcattcatttattcactagctttcctaaaattattttgtttgtatgcaaaattaaatagtttataataaatttatatgattaattattttaataactaaataaatccttaagaaatattatattactgttatatggattcatgaatcaaaagtacagtttaagaaagactgatttaaaaattattaaaataggaaagatgattactgcaaatgcctttagtaaagactaactgatgtcccaataggacagaagaatatttatttgtattagtgtttggcttaaaaaatatattaaaactacacacacacatatagatttaaggataatgtgatgttgtgagagaactaatatccatcagaaaataaacagatctttctattcttaatatcattttgaaataagtattatttaactgttggctgccagccttattagggactctccaagcacagaaatgagttttagtgtttcctgaacctctaaggggcaaaggttttacacttttgctcctggttaaatggagcaaatggttaaatggttaaataagtaacagcttcaaaagtcacatcccttttatgtcacctttttattttatcaaacaaccgttagtttgattagggaactgtgcatctaaataaactgaactaaccatctattttgcaggtatctatgtacacttatattatacacattgcatatgtgggtatttgtgtcattttctaatcatagttaaatctgaaggaggacatacttttttaactttgtatatttttttaaatgaacatcacatacaagattctctctggctgctcaatgggtctgactactgggtattgtggctttaagctggaggatatgttttaatctacgcttttctcaggtttgtctccttcttattacttaatcatccaatgagccttacagaactgtcagtttgaaaggcaataaactgtgtatggatttttcttcttctttaggattgagaaagtcccaatcatggaagcaatgaaagaaacttccatatacctagtacttcgtttcctgacaatcaaaggcacgtgctaatgatgaccttaggcttctggctacaaatgtgagacagggctgacaaatacccatcactgaccctgaaaaacaatatgtgacaagttttaggataaaagcccgagtgcctaggataattactgagcaactagacagtgcatcatgtgacctggttgtgacaggccaaagaaacaatgaactgctgtgtccccagggataccaatggttggggcatatcttgttgactagggatcaaggaggtttctattaaactttaaatatccattaggatatgtgtttcaaaaatgtatttttacaatacaaataaattttataaaattatataaatttattattttataatatttaaatactatatttattttatattattttaataattaatacaaatgtattattggtaacccctatctgaagtccttctaaaaatattaaaagaagatttttcatttgcagttttaaaagtacaatattaaaacagtctttattgagttgactgtttgggtcaataacaagttaacagcattgatatctaaaacaacaaggaacatatttgttaaagcatgagaacaatgtctcatataagaggagacattgatgaaagggatgggctcagacagctattcatgggcaaagcttttatatgtttaaaaaaacatttaaatcaaataacaaacaaatgtttattgaacaagctttgagtgggggacatttttaagtcagtttcctgttctaacagattgtaaaaatgaaaatactttgaatcctacaacacatcaactttttaaatttgtttttgtaactccttttttcctttcacataggggataaatatattgtagtcatttaaacattaacaccataatttcttcctcacagatgtagacatttaagtgtaaggagattgaatgttttccaagaaaaaggcagtgagctgaaagacaaacctaaacatgcccattcacttatatatacattgtcagtcataacagcatattatcagaattctataatgcagtaggtactagggttataaaatgttctgattaagtctatcatataatggagataggacactaattaaaacatgctattcatatcattaccgaatgcagtaatggcaacatgaatgagtagcacggatcagaaggaaaggtaactgaaatctactgcatggagacaggagaggcttcatataggttggtgcaaaagtaattgtggtttttgccattaaataataaaggtagtccttgggcaaaggcttgaaggatgatatttaagatagctaaaacagccatttgtcctggtcctgttttttgtcagctctgagaccttgaaacaaatcaattatctctctggatttcagtttccttaccaataaaacgagacagacgtttcaaacaatcacagagatttgcaacatcacagttatgaatcttctattggggaattttccagaaattgtacaatgagttactaaactaaaatcacaattcatgtctctggaatttccatatttatgaagctaatttctgtcttgttaaagccatactcaagagactatcaataagtagcaattctcagcataatttggactcatttagaaagcaacactgtatatctcaaaatctagcccatgaaactcatgacgttcactataaactcactactattcactattctttagctacaggggctgcctttctgcctcacgactaccacacaaagcacatttctccctcgggacctttgcactagctctccctcagcctgaaatgctattgttcaagtcttcgcaggtctagctttttcttgtctctatagtctgatgtcacattgacttgttagaaaggtctttactatctaacatatggttgccagcatccaacctggacctctcattaattacttttcctatttaatttctttcagagaatgtattaccatctaaacttatcttcctcatttattttactatttaattgtctgtttcccccaataaaataatgcaagcaggaattgttcactactgaatgtcttgttcactgtggaatattcaaatgacagaaagaatgcctgaaactgagttggcattcaatgaaagagggaggtgggaggaggtaaaggaggaagggacaaatctacaaaggaaactttggaaaatcaccatatcagaggaattattttctccttagtatcgatctattcatttcatttcaccatccaaaagaaaaccagttattcatgaaagcaatcctataaaggtttgatgccatgactcaatatggacaactattcattttcaaccatgaaattcaatatgttcaatgacacctcaggctatatactaaagccaaaaaatgaagttgttaaagaatagataaatggtattgagtttatgaaaagttattgctcctgaagcagtaagtgttgcatttttatttgttttacatgaaaagtaataatttgtgtcaaaactgtatttatcagccattataaaaaacaaaaagctggaataagatggccaattttcttttctattttctttgccatttccactgtatctcatattactgactacttcctcttgtaaattgcctcttttgtttcaagatattattttcctgtcatttcattttctttccacctatataactgtttctttttcattcttttcctgaactcagcttcctctaccacccttcaaagacttgcgctcctcaaaatttctatccacaaaatctgtttggccagttttattcacacttttaatttcacatttgagctgatgatcctcaaatatgtacatttagcgcagacctctctcactggtttctttattcataaatctgcttgttctctagatattatcacttagatctttcactgaaatctaactttgaaatttatgagtctgggtacttaacaaaccaatgtataaagtttactgtatactcaacattgttcaagcattttaataaacattaactaatttacttttttaaaaactctatgaaatacgtactattattatttctactttggagataagagtactgagacacagctagttcatataacttgccgagggccattcaactaatgagggatggaaagggcactcattcctggcatccccattggcccagatctcccaacccgaaaccctggatatatcccaaataactcttccttgcctcagatcaaaattctcactaggttctagtgatttttacctcctcaatgcttctctaattaattctttactctttaactcctgtaccttacttcactccctgacgatttctttcctgaaacatctcagtaggcttctcacttttcactgtgtcccttttaagtgcattctctacacttccagcactaatttttctaagaataaatataatcatgtcacttccttgcttaaaactatccagtgactacccactgccttcataggaaaatccaaactccttggcatagtatatcaggtcaaggtgcttcatctactaccaccatttcatacaaagcctacaatccagacatacccatcccctacagtttcctaaaagtataatgctcatctaaaatatgtacctgttcacatctcttcctttatctttaagctccctctaggttggaagacatgatccttccaatcatgtttttactcatttgtcacactattttattgagacacctcttgaaagttcaggttcatgatttctgtttctatatgcccagtatcccccatggtacttggcacatggcagacgctgagtaaacccatgttaaatgaaagaatggacacacatgtgaaattctttaagcttatcttaactgttttatcagactaatgagacaagcactgaacgaagaatgaaattgagtttggcatttgtgatgcagctatggccctctaagcaaagctttgatcttgagcttcctttctaattctagcattctatgattcaactctattaaaagtccattgatacccttgccagcaccagttgccttacaagcaggaccaccggctgggcatggtggctcatgcctataatcccagcactttgggaggccaaggcaggcggatcacgagttcaggagttcaagaccagcctggccaacatggtgaaaccctgtctctaataaaactacaaaaattagccaggcatggtggcgagcagctataatcccagctacttgggaggctgaggcaggagaattacttaaaactggaaggcagaggttgcaatgagctgagatggcgccactgcactccagcctgggcaataagagcaaaactccatctcaagaaaaaaaaaaaaaagcaggatcaccaaaaaatataattccacaatgttgggacttggatcaaatggcatcagatagcaggcatactctggcagcactctgtgccaatgtccaaatctattaagtttgtttactaactagtcttattatctgtttcatgttgggatttctttaggatgtggtaaaattggacagatgggttgaaagtcttccttcaggcacaatacacatagcattgggcagatgggttccaataacctacctttaggcctggaacacatggatgaaacaaagagaaaaagaatacaccactatccagtgatgggtagaaaatagaattgggaatggagaaatttttaaatgagacctgaaatatataaagtaaaactggaaagtggcacagtgtcacttaccttcaaaggtacaaatttttcagtcagcaagctatatattatagtaatgagtgaccttagaaatctaaatgtaacttactgaaaaaagagatcaatcttagcaataaaagatatcaactggaaataagttttgtagtaacaagaacagggctcaactgtatttaatatctctcaattaattggatgaggattttacagaatagtaaacaaatgggcaaatggcagtaatctgtgaggaaaagaccagacttcaagagaatatctgcagtgtagaaagatgaactgaaataattaaatgaagggataggtaaaaagtattgcccttagattccctcaaaacccaagggaaagcaaaatcagcccaatacaactgtacaatgtagagatatgtatttgtggcagcacaaatataaagagcaggaattagagctgacagtgtagttggcaggactaatggcatgacctggctggaaaaagaagttagtttaatatttgactgtattaacagaagaatcatatctgttctgatagctggaggctgactatgctggagagcttctgttgacacctccatttccaaactctgtgcttctccaccctacccagtgccccaggatgtggctgacctatgtgtactgcatcaaggagttctcctttattctgacttctcctttattctgacttccagtcggatgtggccaaatggtagcacaagcagaagacaggagggaaacaaaagaatgaggtaagagtgtttattcctatagttccttccatgtactggttaaatcccagccatacaaaggccatgcctctgggatggtctgacaaccatctctaaacctccctctttatctctgggttcctataacattcttttctcaatcctttatggcaagaggtagtaaggataactggctttatgagccctagggtatacctcatcccatttggatctttgtaaatcatttctttatttaaatcccttcaaactgtctaatgcatatgacatatattttctgtgggcaccctggctgataaacatttattgaacacctactacataccaagcacttcctatgagttatgtttaatatccctctgaagaaggttctactcttatcccacatatgttgcagatgaagaaatgaaggtgcccagaggttgacttgcttaaggtcaaacagccaacaggtggccaaggtggatttggacccccaacatctgacttagagcccattctgttaactgctatactcatctcactctgttcagaatagtcagatcccacctgggaatagttctttctccctggctttcagaggaattaaacaaaacaaagttgtgtttagaggcaatgccaataagaaagagggaatctcataactatgggaaatggggtgtacaaatttgtaaaatttttctgaaaagcaatttggcagcatgtattaaaaatcttaaaatatgttcttatccttaggcccattaatttcatttttaaaagcccatcctaaggaaatgaagatatgaataatgatttaattattgaatgttcattgcagagtgagttacaaggacaaaaatctgaaataacttaggtgcttaacaatagaaacatggctaaattattatatatacatgtatatctatatattcccatatattatataatgttgaaattattgaagttgggcctttgaaatataatgagttgtggaaattcttacattgtttatacaggatcaaaaaaatcaaagtatgtaccctacattttgaaatacatgtgtgcatgtgtatgtatgtgtaagaaaaaaaatgactttgagataaaacaccaaaatattaattgtggttatatttgcacttggaaatatttgcacttggaaactttgagtgatcacttcatttccaccacataattctctttgtttttctgtgtttgcagttttgtaccatagactaaaaagaaatacttaaaacagcaataactatgaaccatggttataaactgtatgacctaaaacagaaaagattcaaaaagatgtgaatgaagggctatagaattaaaaggagtaagatacttgtcctgaatggctcaaggggaagagcctgaacctatagaaattagaggaagatagattttagcttaatagaacaaaaagaattctaataggattttaaacaatgggaacaggttgccttgaaaggttttgatttttttgtcactggaagtattcaagaaaaggattgaccatattttttcagaaatatttttacagtaacttaacctttgttcaggtaattagacctagaattttctcccaactgagattctaaaattttcatgctacctaacaaggatatctaaatatttccttaccaccagagatatatttctttggaataagatatgatttttttctgggcattctctttcaatcttcttcctggggcaaagtaaaatgccttactaaagttctaaattagttcctttggagacagggtacatgtcttttcagcatttatacctattgcttacaacagttctaagtatatagtctacccataacatttcaggtttttttatttaagtaagccaaatctggttaatacactaccctagatccattccattctgcctgtcctgtggcctcaacaacatgatccacttcccagcaagaggagcctcatctccgagcacctactgattctctggtccttccactagctacccagggagccacaaaaataacaaagtcagaggagttaatggcatggaatgggccaggtgagatgcttgccttctcctcactacctcttccatattgtcccaagatatggtggttctaataaggcttctctcaagatatcccacataaccaagcaaaccaagcatgcttctttgagaagctgtggctaccttgtatttgctttccctccctttcctcctcacttttcttttcccttcactcacacatctttgggattatttgtcccagtaaagtgctagcacatagctttgctttcaagtctgttttcccaggaaattatgttaagacaacaattgaaattttattgtgagttagttgatcagatgatatcaaatccatcctatgatatcttctgaaagagcgagttaaaggcatattctgacacaaagaaaacctaaaggaagaattgatctgtagcctggaggaggtaaaaaatcaccctggaatgagcagtagcaggcggaccagaaacagcctgatagtacacgggcatgaaagaatgaccaatacaagccacctctgaccacatgtaaagcttgccgaagagcaactttactggtgcactcactactaccttaaccctccctaaactctgttaagcaacctgcttgatgataccatctgtttcccagagccccttctcacagaatataattctcaacatgctcgcaatccttgtgcctttactcaccaactttcagctccccgcctgcaatgaccatgcatgccacactcagaacattgcttctgtccacagggaagtctaaggtccccatcacatacagccctttgaagaatggaagatctgtatccacaaggacagttctgtctgtggaagaaaaagaaattgctcagatatgtcacaaaaacaagaattacgtgtttattctggggttctcccagcagtttgggagctgtgtacagtgttatctaaaccaggacaggtatagcaactggaagaacaaatagtctgccaaaagctaggacttactgaacaggaaaataagttctgattgataaatgctgcaattgcttaacataccacattcatggacaaaatgcactgcttatgcaccaaacagctgccccaagtctagtgcagtggaaacacacagatcgaatgagctccctaccctttgtcctgtctcttcacttttggctctagtttcagggatgtacagaacagtagacatgacattggcctctgagggaagactatttggatgtgaataccaattctgctacttactagctgtctaggcaaataactttatctctctgtgcctcggttatctcatctgtggaatgggaataatactaaaaacaactgtttcgttcacaggactttttgtgagggttaactcatttaattgagttaatagattgaaagtggttatacaatgttagtaagctatctctaattccctaagtcccattgtgtaaggtaaagtacatggtgcatgcttaataaacgcttgatgttattatttttactgttgtcccttagcttcccatgcttatagtgcttactggacaatttaaaatcattatattttatttcccctttcataaaagcagtcttcatataacttcagaagaaataatcatagctgttgcctgagatttactatagagtaatatataaacacaacattttcatttaaaacaataagtatttcatgtatgccaaagcattaagtgttactttctgaaatttagcagtaattcaacactataaatgacatcaaataaagatttttgcttaaatttctagtaccataatcaccaacacatgtaaagatttataaggaattcttttgttagtataatctcatctctcattctaggaaacaatgcacttgctcttcttaaggacatgcccaagcaaattaacttgtcatgagttgtctttcctagcccctccctgcttcctgcattataagaatggccatgccctcctgtggcagagactatagggttgtaaaccaaccatttctcttgttttcctaagttcacagttagactacagtttccacctcctttgcaggttgatgaagccatgtgactgagttgtagccaataaaatgtgggaaaaattaaagtatgacatctctaggcctgttccataaattctgtatgccttttccctccccttttctctcagttagatgtagagcagtggttctcaaagtatggtcctatcccatcaggatgcaaagcaagcattagttctgctagcaagctattctctctcctcactggctccaccactctccctggggaaacaacctctctcttttacactccagtgacaccctgtacatacatctatcagagtactgagacacattattcaaattatatacatacattattgtacgtgaggaagtaactgtcactgggctggtcctcagtgtgattatgacttcctctcccactctgacttccttaagtgaagagatcattctttttctttttaaatccctagtgtttttgcaatactgaagataaagacactaaataaatgtcgtccagatctgttgagtttaatcccctacataccttaaattcaagagctcattgatgactggtacaaaatgaatgatcaagctaaacagacaaaaataaatatatatcttaatctcatctctagcacttttcaaaatattcaaataaaagagtgaagtacctagagaatgttctaggtttagcacacattttatgggttcatgactttaagaattatttgaagcaaaatttgtaaaaacaagagggttttgcctccaatttatttacttatttattttattttcatcttttattttaaattcagggatacatgagcaggatatgcaggtttgttaacacaggtaaacttgtgccacggtggcctgctgcacagatcatcccatcactaaggtattaaacccagcatcaattagctattcttcctgatcctcttcctcctcccaccacctgccctctgacagaccccagtgtgtgttgttccctgccttgtgtccatgtgttctcatcacttagctcccacttacaagcaagaacacgtggtattttgttttctgttcccgtgttaggttgctaaggataatggcctccagctccatccatatccctgcaaaggacaaatgagataattctcattcctttttatggctgcatagtattccattgtatctatgtaccacattttctgtatccagtctatcattgatggacatttaagtttatttcatgtctttgctattgtgaatagtgctgcaatgaacgtatgcgtgcatgtgtctttaaaacagaatggtttctattcctttggttgtatacccagtaatgggattgctgggtcgaatggtatttctgcctctaggtctttgaggaatcgccacactgtcttccacaatgattgaactaatttacactcctaccaatagtgtaaaagcattccttttgctccacaaccttaccagcatctgttgctttttgactttttttttttttttttttgagatggagtctcactctgtcgtgcagtggcgtgatctcggctcactgcaagctctgcctcccgggttcacaccattcttctgcctcagcctcccgagtagctgggactacaggtgtccgccaccgcgccttttttgactttttaataatagccattctgactggtatgagatgatatctcattatggttttgatttgcatttctctaatgatcagtgatgttaagctttttttcatatgtctgttggctgcgtgtatgtcttcttttgagaggcatctgttcatgttctttgcccactttttaatggggttgttttttcttgtaaatttaagatccttatagatgctggatattagacgtttgtcagatgcatagattgcaaaatttttctctcattctgtagcttgattaccctgatgatagtttcttttgctgtgcagaagctctttagtttaattatatcccatttgtcaatttttgcttttgttgcaatggcttttggcatcttcatcatgaaatcttcacctgtgcctttgtcctgaatggtattgcctaaattttcttccagggtttttatggttgtgagctttacatttaagtctttattccatcttgagttgatttttgtatatggcttaaggaaggggcctagtttcagtttttctgcatatggctagccaattctcccagcatcatttattaaacagaatattcttcccccactgcttgttttttgaggtttgtcaaagatgagatggttgtaggtgtgcagtcttatttatgccttctctttctgttccattggtctatgtgtctgttcttgtaccagtaccatgctgtttggttatgctgtttggttactgtagccctgcggtataaagttgggtcacatgatgcctctagcttttctctttttgcttaggattgccttggctattcgggctcttgtttggttttatatgaagtttgaaatagtttttactaattctgtgaagaatcttaatggtagtttaaggggaatagcaatgaatctataaattgctttagatagtatggccattttcatgatactgattcttcctatccatgagcatggaatatttttccatttgtttgtgtcatctctgatttctttgagcagtggtttgaagttctccttaaggagaactgttcacttcccttgttagctgtattcacaggtattttactcttcttgtggcaattgtgaatgggagttcatttgcgagttggctcttggcttgtctattgttagtgtatggaaatgctagagatttttgcacattgattttgtatcctgagattttgctgaagttgcttatcagcttaagaagcttttgggctgaaacaatagggttttcaagctataggatcatttcatctgcaaacaaagatagtttgacttcctctcctcctagttaaatatgctttatttccatctcttgcctaattgccctggccagaacttccaatactatgttgaatgggagtggtgacaaagggcatccttgtcttgtgacagttttcaaggggagtgcttctggcttttgcccattcaatagaatattggctatgagtttgtcatatatagcttttattattttgaggtatatttcttcaataatttattgagtttttaatttgaatgtatgttgaatttatcaaagggcttttctgcatctgttgagataatcatgtggttttggtctttagttctgtttgtgtagtgaatcacatttactgatttgcatacattaaaccaaccttgcattccagggacgaagactacttgatcatgctggataaactttttgatgtgctgctgtattcagtttgccagcattttgttgagaacttttgcattggtgttcatcaataatattgacccgaatttgtcttattgtcaggttttagtatcaggatgatgctgacctcataaaatgagatagggaggagtccttcctttttaattcttggaatagtttcagtaggaatagtaccagctcttccttgtaactctggtagaattcagctgtgaattcacctggtcctgggctttctttggttggtaggctacttattactgccccattttcagaactcattattaatctattcagggattcaattcttcctcgttcagtcttgggagggtgcatgtgtccaggaatttatccatttctcccaaattttctactttatgtgcaagaggtgtttataatattccctgagggttgtttgtgtttctctggggtcagtggtaatatcccccttgttgtttctgattgtgtttatttcaatcttctctttcttctttattaatctagctagcagtctatttaattagtttttttttcaaaaaaatcctagatttgttgattttttgaaggcttttcatgtctctatgtccttcagttcagctcagatcttggttatttcttgtcttctgctagctttgaggtttgtttgctctaggttctctagttcttttagttgtaatgttagattgttaacttgagatctttctagcttttagatgtgggcatttagtgctataaatttctgtcttaatgctgctttagctgtgtcccagatattctggtatggtgtatctttgttctcatgagtttcaaataactctttgatttctgccttaatttcattatttactcaagagtcattcaggaggagaaggttgttcatttccatggtgttgtgtggttttgaatagatttttttttttttttggagacagagtctcatcactctgtcacccaggctggagtgcaggggtgtgatatcagctcagtgcagcctcctggattcaaatggattcccttgcctcaggctcctgagtagctgggattacaggtgtcttccaccatacctggctaatatttgtatttttagtaaagacagggtttcaccgtgttgcccaggatggttttgaactcctgaactcaggcaatccacccacctcagcctcccaaagtgctgggatgacagctgtgagccactgtgcctggccttgaatagatttcttaatcttaagttctaatttgattgtgctgtgctatgagagactgttattatttcagttcttctgcatttgctgagagtgatttacttccaattatatgatcaattttaaagtaagtgctgtgtggtgatgagaacaaggtatatgcctttgttttttggtggagaggtctatagatatctatcaggcccactttatccagagttgagttctggtcctgaatatttttgttaattttgtgtctaaattatctgtctaatattgtcagtggggtgttaaagtctcacactattattgtgtgggaatctaagtctcttagaaggtctctaagaacttgctttatgaatctgggtgctacagtattgggtgcatatatatttaggatagttagctcttcttgttgaattgaaccctttaccattatgtaatgcccttctctgtcttatttgatttttgttggtttaaagtccattttgtcagaaactaggattgcaacccctgctttttttctgttttccatttgcttggtaaatttttcttcattcctttattttgaacctatgtgtgtctttgcatgtgagataggactcttgaagacagcacactgatgggtcttggttctttatccagctttaaaagactctatgtcttttaattggggcatttagcccatttatatttaatgctagtattgatattgtgtgtatttgatcctgtcatcatgatgctagctagttattttgcagacttgtttatgtggttgctccatagtgtcactggtctgtgtatttcagtgtgtttttgtagtgactggtaacagctttttgttttcatatttagggcttccttcagttcttgtaaggcagatctggtggtgccaaattccctcagcatttgcttatctgaaaaggatcttatttcactttcagttatgaagcttagtttgtccagataagaaattctaggttgggggccaggtgcagtggctcgtgcctgtaattccagcactttgggaggctgaggcaagtggatcacttgaggctagaagttcaagaccagcctggccaacatggcaaaacctcgtctctactaaaaatacaaaaattagccaggcatggtgatgcatacctgtaatcccagctacttgggaggctgaggcacaagaattgcttgaacccaggagacagagttgcagtgaaccgagatcacaccactgtactccagcctggggtacagaggaagactccatctcaaaaaaaataagaaagaaagaaaaagaaattatgtgttggaatgtcttttctttaagaatgttgaatatctacccccaatctcttttggcttacagtgcttccattaagaggtctgctgtttgtctgatgggcttccttttgtaggtcacctagcctttctctggttgcctttaacatttttgcctccattttgaccttggagaatttgatgagtatgtgtctacggaatgatcttctcatggagtaccttactggggttctccgcatttcctgaatttgaatgttggcttgcatagctaggttggggaagttttcctggacgatatcctaaaatatgttttccaaattggtttcattctccctgtctcaaagcaagagttttatacaaattggtttatatctgttccaacctatagcacactcaaccaatattcagctattaaacctgattgtacaaaacaataaaattggttgaactaatgctttctctcatccacagagtactcacacatacacataaaagtatgatagtaggtgcttttagatgtatttctcagctaaaatatgacaagtacatgaagttttaattatacccctttcagaagaaattttccctttcaattgccctaccaactccaaatgtaccaacaaatttcccatgaatcacagacagactattataaccacttgagaacaggaacacagctgatgttctcacttttattttctcaggacctagaagaataatatttaacccataatagatggtcaaaattaacaccacacacacacacacaagcacacgtgtgtacacacacataaattccaatagttatctaaggaaaagtatagaatgaagacaataacagaaacattagtcttatttcttttggtgccacactcttcactttgaaattccctggattcatctctccattttttcttctttctttctttctttcctttcccataatgtgacaaattttgaggtggtaggaatttaaacatgagtaagtcatgtttcccaccatcagatgaaaacaggtatatatacaaataaataatgtgatatacttgaaatgatgacatactttttaattacatggaggttgactctgtttttattcccagctgcttcaaactggagtctatcaatgtgtctattataagaaaattctgctaaaataaaataagcacatgccatatagagatttttataaaggcattctccttgtatcacaataataaatatttcagctagttacatgagcaaaagaattcaccctaacgtaccctccagagcagatcatctgcaggtctaaactgacaaatcctcagctacaatgacacttgcagaggatttctctcttttgaggagtggaaagctggcatctatgtgccacattctctagaattaacatcctttccataaaattactcaagatatttcagagcaatcactcagaaatagttatttatacaacttacttaataatataagtgatggaccacctctaatttaagtgtgttccagtgctttccaccgtgtcctgccttggctacagatattccaccctatcctgtcagtgaccaatctatcctacttgagagaatcagcactggcatatggagggaaccatctggaatttctgttgctcaatgggtggctgatgggggagctgatctggaaagaggctccaaaaagaattaatgagttccagatgtaattaaagactgcttttccccccaaaggggctcaggactagccatggggtggtgcctcttggttccgaattacaccctttaaccacttgttcatccatcaagcactaaacaccaccatctttatcctagtgtgttttgccaagcagtgttttggctttttggtctttttttcctgaaagtgttctatttttacaattagaacactaaagctttaaaaataatatctggaaagttaacaataaggagaaacccctgaatttatccctgcaccaaatgcaacaacaacaacaacaaaaaagactcagtgttttattagaaatgcattaactagcctcaagaccagaaaacctgagccagactgaaagacagatgtctctgaaagagggctggggcttcttttgtatcaagaacaatttgactaccacagttacaaagcattccatgtaagttgaacgctagatttaaactcactttttttcccagcaaagtagggaatcaaggtcactattgtgtagcattccaagggtctgacacttgtctaaatcctgtagaaatgagatcaagggcaaagggcacagatcctgggaataatgatggggtcacatgaacaggcataatttagggcaggcagacccactgcttgtatggtatgcactgtatcaggccccataacttaggtggtaagacagtttctattacaaccctgctattgtcaggaaagcagcctgtactgactttggacacagctcagacttctgagggagagcaatggcatgccaggcagagcaggacatacaaggactatttgtgggcttgttattttcctgtaccttccataattaatgggttttttttctacattcagccttggctcctgtgttttctattaaatatgtgaaccaaaggaaaagtaaattttaaagctatttgaatcactattaaatgatctaatcttcctttgtagaaagaaaatatttttagctccaaagtgactgctttaaatatacattttacacaatgattggtgatattttctttcttttgtggtctcgtttaactttggaggcatctaacaatttatttaaatagtctatcataatttataaagatgaatgataacatccaagaaaagtattcctaaaatagaatggaaactcttatacataaatagttcacagagatgaaagatgaacatgattgaaaattagtgtcaagtagactaatttactgagatgatggtattcagttctctagagttcattctcttgtagaaaaagctgaccagagatgtgctagaagataaggatgcagtctttctataactaaactcttttcaaagaagtgctagctttatagtctgcctttttcatcaaatccacacaggtggtttctttattctactctgcccatcattttttttcaaactggtcttaaaaataggcagaagaggcagtttcaaagtgcccagaggcacacgattcaagactaaaagccagtttcctgacaccctgaagaaaaaccatctgctggcctgattgtgtgtgtgtgtgtgagagagagagagagagagagagagagacaggatggaaggggaggagagaaaaatagctcttctcactctcacctcatgagaagagtcccatttaaactttggacaataaatccccatcccactccccacattctttctgtgtctttttcaatcacacacagacatgcataattcccatagtagaataaacattttaaattatgatattttaattgatcaataaaatgtttaacatacaatgtttatttcttcctctagtctataccatctgttcttcagaaatattttgaatctatttaataggaaggtttttaagtaaaattaccaactgtatcagatcagtcctctgcatcccaaattctgaaaggagaataccagaaggtgctgctgttttcataaaaatagaaaagaatctgtgccttctctcatcccaggctttattattattgttttaaatctagagacggtgctatgctactgttctcttcatcagacttcaaagaaatcagagtggacgacatggcattgccatttaaaccaaggtctatagttgtcaccttgctcagatggctcaaggcaaaaacaacaacaacaacaatcaaacaaacaaaaaacctagaccttgcaatccccagaagacctaaaaaggaacaatatgcattttgataaattttaggtctgatgttaaactacagtttggctttatccacataattctattacctgtatacattgttaatgaattctaactaacatgaggtttggagataaaatccctctccaatcctgtagtgaataatgcttaatatgtgaaaaggcataaactggcaactctcaggtgatccaattattaaatttttacatgttacagttggtgttaaagccaaactaagcgccaaacttattttcctatgtgggtttttgttttgatttgtttccttaagaataataacatgatcaacttttagtaaataaatatattttgtacttttaccctgaatagaaaaatatgaatatctatgaaataagtgattcactcctgaacggtgctgtttaggcaaaggtccagatatcaaatattgtatcaaataagtttatttctccccatcaggtcttttttgaaaataaatcttctctttttgtctctgcttgacactagacagggcaatatatccaaaaaactatgagattctttaattttcctcggtattattgactttttttcttaagttctcaattgtttcttctgcaggaaaagaaacccaaaagattattaaaatcttaaaaataagatgcttgtatcctatttgtttgttaaatatacatatattatatcaattataattgatgtttaagagagagtttaaaatgtagtatctgagtaacaaatatttagtaaataatctctactttctattttaatatgttgtaccaaaatttatattttctgagcaaaccaatctatatgttgtgctcctaaattaataaagtgcttatattttataaagtacaaaataacttctgtagaagttgtcattgttctcaatatttttatattttccatattttttggaaagtccccaaaaattaactcccttaaaagtcttcttgtaaattccagtaaattacatgtattcaaagcaaggagttcttgcttggggtttccaaaatatgttattttccacttgaattcgaatattgtcccagagatcatgaaggttcctagaatgtttattcacaattctaactattctaacaataatatctggattctacaacctctatcaaaagtcccaatactctaaaatatccttgcttggtaaacatactgaaatccttgtccttagagttaattcctctttttaatccaagatgactagaagaccccaggagaaaaatgatatataaagaaaaggtattatcactgaccaatacatttgctcattcatccattcattcacttagcaaatactaccaagtgctttgtcagacactgtgatatatgccaaagaaacaaacataaataaaacaaggctcctacttcacatagagaagaaattttttttttgagacagagtttcactcttgtcacccaggctggagtgcaatggtgcgatcttggctcactgtaatctccgccacctgggttcaagcaattctcttgcctcagcttccctagtagctgggattacaggtgcccatcaccacgcctggctaaagttttgtattattagtagagatggggtttcaccatgttggccaggctggtctcaaactcctgacctcaggtgatctgcctgcctcagcctcccaaagtgctgggattacaggtgtgagccaccaggtaatgaaattgatgggatgagttttggaagaacaaagaagtagatgtgaagtccttttagtatttgcttgtgatacccaccaaaatgatcatggcaaagcccaggcaacatttcaaagtaaaaaagactatgtctgtttcttcctactttcgagtgcccatccatctctgataaactactgacctcatttgctcataactaccaaatggccagaatcccactgatgcccaaccaccaacagtccacacagatgaagggtctcagtagttctatagttccagtaatttctcagctgtgtcccaagtccctctaggctcaactcacttatacatgactaagtagagaaatactaattcattggggggggggggggcggtaacaggagaaattaagcgaaatgccacataaaaaattattacagtggctggcacataaaaggcattcaattatcagctattgttttcatatgcccaacatgtagcttggagtacttgctctatacctgtcacttcgctattgtgtgaaccaaagagacacagttcttggcctcatgaaatctaaaattttgtggaggaaataagacattaatacacaattgcaaaacttcataagcacaaactctgcaaattggtaagaagaaaaatacataatactatgagagtaacagtgagggatcaagggtgagacctaaagagtgagcagcagttaactaggtgtagagttgctccagagaaaggaggcaggacagatgaaaagtcagaagcgggaaagagctccatacatccaaaagactgaaaagcgagaaatgcaaatcaaaatcacaatgagataccatctcacaccagtcagaatggctattattaaaaagtcaaaaaataatagatgctgacgaggctgtgaagaaaaaggaatgcttatacactgttggtgggaatccaaattagttcagccactgtggaaaaaagtttggtgatttctcaaagaactaaaaatagaactaccattaaaaccagcaatcaccttactgggtatatatccaaaggaaaataaattattctaccaaaagacacatgcacttgtaggtttatcacagcactgctctcagtagcaaagacatggaatcaacctacctgcccatcaatggtggattggataaagaaactgtggtacacatatgccatggaacactacacagccataaaaaagaataaaatcatgttctttgcagccacatgggtgctgctggaggccattatcttaaacaaattaacacaggaacagaaaactaaatactacatgttctcacttataagtggaggtaagcgttgggtacacatggacatagaaatgaaaataacacactagagactgctagagacggaaagaagggatgaaggcaagggctgaagagctacctattgggtgctatgctcactacctgggtgaaaggattcactcatatcccaaacctcagcgttatgtaatacttacatgtaaccagcctgcacatgtaccatctgaatataaatgaaaagttgaaattatattttttaaaaaagactgaaaagcaacaggaatgcccacattgctgaatctggaggagagaggtaagaggcagggctagaaaggcgggcaagagagcagattaggaagactatgtaaaaacaatgagatttttgtcatgataatgaaagtaagccactaaggggaaatgaaagagggaaattacacagccaactcatatttttcagagtgctctggctgcagtgggggagaatggagtagatgagggtaagcacagcaggagaagaataattaagaggcattctatggctgcatagtattccatggtgtatatgtgccacattttcttaatccagtctatcattgttggacatttggcttggttccaagtctttgctattgtgaatagtgccacaataaacatacgtgtgcatgtgtctgtatagcagcatgatttataatcctttgggtatatacccagtaacaggatggctgggtccagatggtatttctagttctagatccctgaggaattgccacactgatgggaggggggagggataggattaggataggattaggagatatacctaatgttaaatgacgagttaatgggtgcagcacaccaacatggcacatgtatacatatgtaactaacctgcacattgtgcacatgtaccctaaaacttaaagtataataaaaaaaaaagaggcattctagtggttcacccaagaggccatgatgcatatattagggtggtgagagaggaaattaaaaaacacatatctgagtaacattcaagaagcagaatagccaggattggataaagtgtcaagaacaaccctgagcaattgagagtggaagatggtgccatgtgctggaatgggaaagctggaagaagagtaagttggccactggcaatggcaggcttggtagggagagagcaagaatagaggattctctctgagttattttagtttaagataactgtacatcatcccagtgcagatttcaagtggacaattacacatataggtctgatccttgggaaaagacaaaacatatttatgagttcaagaaccatcaatagcttcacaactagaaaatgtatgttctccaaaaatcaccaagacagaatgagaagaatcgttatctaaaaatagatgagggtttttttttaattcaagggagtttttaaaatcatatggagcattcaaaaatgtgtttgctaataggaaatgtcatatagagagggaaagactgcagacaagaaagagaaaggaaggagacaattatggactgagatatctgaaaaggaataacagcattaagatgcagagaacatcaggtgggattatctttgggagaaggtaaaacactttgttacaacaggaggaaagaaagagaagaaaggggtgctgcaatttacatatacttgtctcctttaaagaggagcctgaggatacctaaaataccctgcaaaagactatgaacttgggacacactttcagttcacctctaaatcatatcatgtaaacattagacttcttctgctaataaccaatagaaatcagggatgatctctactataaaactctgtgtgtaaaaatatatctatctggccaggcatggtgactcatgcctgtaatcgaagcactttgggaggccgaggcaggttgatcactgaggtcaggagctcgagactagtctggccaacatggtgaaaccccatctctacttctctactaaaaaaatgaaaaatattagccaggcatggtggctcattcctgtaatcccagatacttgggaggctgaggcaggagaattacttgaacccgggaggcagaggttgcagtgagccgaaatcatgccactacactccagcctgggcaacagagcgagactctgtctcaaaaaaaaaaaaaaaaaaaaaatatatatatatatatatatatgtatatgtgtgtgtgtgtgtgtgtgtgtgtgtgtgtgtgtgtatccatctatatgagcatctggcttaatgtctacttaaaaaactttattaccttaacaccatctgaacaggattcttttaaaagtaactaatgagaattaatacgtaagaatgagtgactgctgtataaatacataaaatagttaatgaaattaatgcacatgcatctagacatccatatatcaagccaagcatgtattttacatatggagtctttgtatccatccattcattctcgaatagagactagttctatattacaacatggatgaaacttgagaacatcatgcagggtgagaaacttcactgtatgattccttttacatgaaatgtctagagtaggaaaatctgtagagatggaaagtagattaatggttgcctgtggctgggggagattgcggactagggagttatagcctaaggggtatggggtttctttggggggtaatcaaatgttccaaaattaattacagtaatcgcatgtctctgtaaaaaccacgaattgtacaatttaaaaggatgaattttatggtatgtgaattatatctcaataaatctcttaaaaattaaagtactttttgtactaatatggaataatcatatctttctatactaatatggaataattacatggaataataatagcttttaaagcaaggcacacatagtgtacaatttgtaatatttatacaaagggagtgaataaaaataaatgtagtgtgtgttttttttaatttttgcatatgcagcacagaatatctttcgaaagataccaaaggaaggaaccagtaacactgccatcttcaggaaatgaaactggctggctggaagacatgggtgaagggaaaattttcaatgagcaatctttttctctttgaattttgaacaaagtaaatacactactttaaaatcttttaaaaaattgaaattaaaattaaaagtagagactagtcataattttatttgaaatgcaaattaaaaaagaatctctcacacacacacacacatttgcatgtgtgtgtgtttatgtatgtgtgtcttttagtccttgtcagacatgtaatttttttctgctgacaggaatataagaaatatgagcaagagaataagctgtgcagacttcttatttgacctggctttgacttcctgtttctaatgtcccttaatttacattttgataggtaatgttcctttctcattttatcttcatatttgcaatttttacatttggatatttatggaatgtggatctacgcaaaatttgactctgccattggaattggagttcagtatgatgtttcaatttattctgacttcagtttttgcttgctaagttaatattaggacaagatcaaactccattaccttgcatagattactctctagaaagttctccctattgccactttgctggtccataatcactggagacaacttcctgaaatatggatttatgggaaggcaaacaaagaattataaacacaaagaaaatcagaaaactatgaaagagatatactgaataatcaataatcaattcaatatcccaagaactaatactcaaagatacaaaataaagcaaatggaaaatttagcttaagcatattcccaaacacactttaaaaacacagaatattttagaagcatacaaaaatagtttcttgtatttccttttgattcctttatatttaatataagactctagttcgtctggcatggcatgacttgggaacacaacagaattttttttagcatgtgggtagacaactattccaacataatttactgaaacgtagtattttcccactgttttgaaatgccatcttaattactaagtacattcttttatatccatgggtctgtttctggactctattttgtctcattcactttcctctcctgcctcttcctatgacaatatcataccagctttatctagaccaatcctccccaaaataatgtttttaaaatccttgccagttgtatatttgcttttcctaaaaatattagaatcagcttctcacgttctaattttttttaatctaaatgcaattttaactaggcttacttgaatttataaatccatgtgggggagaatcttttcatcattgtgtcttcctgtatttgtacagcattccacctatttagcaaggttttcagggggtttttcttcacatgacatatgaattttttgtttatatctaggtattttacctttttccatcaaaagtggaatttattgtctattgcattttctaattagtgattgctattatacaggaatgctattgttccttgcatgctagtattgttgccagccattttacttaaatatcttgtattttttttctagaaaaaaaaaaacataggcttaccagtaattgttttcctgcttctttcaagtggctgtgctttctatcctatttttttcatgtactattgcattgtttggtatctccagtaatagaaataagagtaggcattcacgttttattctcgacactaacaggaatgaaattaacctttcacacttaattataatatttcctatggacttcttgtaaacaccttatatccagttaagagaaattcccctatttctgtaataataaattgttgttgagtattaacagatagaaatttatcaaatgcttttaaaaaaattgatttggggtcttggaaaacaccctacaaaattcactcgatactaccatgtaaacactttttcttctaatgggaagcagatgagtttaacatactgtaattgttaactcttgcccttaaccaagggatacaaataatctatgccacattcaagaggaagacagcatattttctacaccaaaagaaaacaacaacaaaaaacaggaaatgccttcaaaaatcttgttttaaatgtctgcttagatttcagatttctttactttagatgcttctataaaataacagagaaattttaccctcagtatcccaagttttccaagacttgtgattgggaaccataataagcctattaatttctgttttggttcatcttctccttcttcagcccactgataccatccttcactctgccccactgccctagaaatagttttctctgctcactcacccttagccacctaaaatatgtgacacttccccatggccctgatgtgccctggaaccttggacagtctgaatatttaagaagcccttactcagataaagacacagagtagtataggcagaagctggcactgcacgtgacaaggggaagaaagacaataaaacttatttagtcattcttggctctttatatatggaatatcgtgcctcattattataaaaagaaagtacaatcttggggaaacagagagacttctaattttgtcttactgaattatgttagattatttttcctgatattctagaactatccttgcattcctgggattaaaccctatttaactataatttgtgattctttggaagcacaggtacattggatttagtaagacttctcctcaatatcaatgagattagcctttaattttcttctttgtgccacctttatctaattatataatcaatcctatagccttaagaatgaattaggaagatttttatttttctccaggttctgaaagagtttataatatggtgattatgtgttccttgaaggtatgttttgcatttttaaagaagtaacccggatgatctcagctataggtaggctatgaattcactttaagatcaactgacctgaaaaaattctcccacttgaacaatgaggcataaatatttttgtcattgtattgtttataaaagtgaaaaaattggggtgaaaatttatgttcatcagtaagatggtaattcaataaattataccacattcctactctgggtaactacactgtcatttaaaaggatgcaggacatttgtcattactgatatgatagtattttgaatatagacttaacttttttgaaagtcacatatgaatacttagaacatatgcttttcattgctgaattaaggaacatcttagcatggcatataagagttctagagtcaaactattgggtccaaatattgtccctctaccaatcacttttatgatctctatttctcagtttcccggctacctgataaagagagatggtaatagtgcttcacagggtgttgtgaggattccaaagtgaattcatccaaaacgctaaggatagaaactgatatgtagtaaaatactcaattaattaatatttttaaagttattcattatataaataaatacacatatttaaaaaaatgtaatcccaactgagaatagcagttatccaggggagggcaaaaagaaagggctaaatggttcttgatattttgctttgtatatttttacattattttgaacagaaaaaaattatgtattatgtttaaaattttttaaagaacaaagttacagaagcctaatactaattgtaaagatgtcagatagccatatataattagatgtctaagacaagaaaggtattggactttcattcaggtacaaagcaacatggaggccagcatggagagagcagcaggaatgagacacacctggatttacatcccgctcggtccctttgtagctgtgggacccagggaatattacttatcctctaagctagggttttaatagctggtaggtccacagacaccctattagagtttcagtaccatttgcaaagttggttcaaaatatagatcactagtaatttagaaacatttccattgacttttatgcatgctaaagtttaagaaacaaaataaagttaagaaaccaaaataaaatacaataaaaattctaagcctcccaaccaactgaatggatcctcctctcagccaaggggattccaaagaaacctgaaaaattagctcaggccacgatgggaaggagtggtcatcagacatacctcattatacattcctgcctttggaatttaggtacaactgaccagcattaacattaaaacagagatattaaaactgacaaacagactattttggagcaataaggtactaaattccaacccaactctagtagagcatcacatgacagatagcaggtcctgaaagtatcaaagtattttaccgcaaaatatatttgtctgtcatattttgaaatggctatgcaaagctgtctcttatgggggaaatttatattctttagagaatcgcattccatctccaggtcttttttagatcctgaagagattagctgagagtctagtacctttcaaatgtctgaataggaaatgtttgccatctattacctctaagggtagtcacctaaagacttcatcttcataataagaaccttggtatgcacaaccctttatcttaacccagacactcctttctattgattccaggtttttagataataatttaactctttcaaccaattgccaatcagaaaatctttgaatccacctatgacctgtaagcctgcttcccacttcaagttgtcctacctttccagagcaaaccaatgtatacctgacatgcattcattgatgtcttatgtctccctaaaacataaaaaaacaagctgtaacccaaccaccttgagcacaagttctcaggacctcctgaggctgtgtcacaggacatggtcctcatattcagctcaaaataaaactcttcaaatattttgaagagtttgacctttttattaacagaactgctctcaattttgatttcttagtgtgtcaaacatggtgccaatgtcacaccatatttataaagctttagtgagataaaataaatatttaatactgtgcctggaacattaaaaaactgaactcatgttattataataacgggtacattgttgctagtactaccactgttatcaccatactctgtaataactgttcctgtgtttaaatgaaggatctgatatttcctcaacatgccatagccttctatggccttatatttatataacttattactttttctggctcaaaaaataaatgtgaatatctctactatttcctacatttttttttactggtaatattttgtggccttctgattttaacttctgaccactattattcaagtaacctgggatcttgaaaaagtaagtgcagtgcttggaactaaaattctggtatggtccttattaacgcaatatgatttgggcttgactgtgatgggagattgtagaaataggataggaaaagaaaagatatcggaatagtagagcttataagaattgtggttaaagttttcctctctgggtgaggcttgtactaagcatggggtggcaaaaactatgttattaataaaatactatattttctaagaacaaaccagccttccccttctctttgttacctgaaaaacctaggcataaagctacatgagtctttggtcctgattctccatttcctttggagggaaaaaaaaagtccacatttctcacacagctttgagggaaagactcataaccatacttaatgtataaaagctgtgatttccatgcaaactgctgctttcccagaaaaatgtaaaagccccctttagcagtttaaaaatcctttaaccatttccttcctgttccacttgaactaggggccagcttgctgtgccttaaagccttccttcagtggctttcagatgaataagttaattttagaagtgttagaaacatttttaattcattcagacttgcaagatatcattaaataccaggtacatacactaggagccaagaagagttactctacgattctctcagtcacagataatttccttaccatactgggatttaggcctagcactgcaaacagcaaaacttgggcttcctcacagtagccaatgtcatagctctaagcctgcaccaatgtttactcatttacactctttcttttatagtttcaccaaaaaagaaaacaaacaaaaacaggtgcatccacactatacaaatgagaaaaggtaacctctgaaaccatttcacagcaaacagaagatccacaagctgctcactagctaaaaccacaggaggtgtgtcaggcaccttgatgctgagccacaggaggcctgcaggcttggaaggcagtaaatccccagagagctctaaactcctgattggcaagccacaccaggcccatcagctcctcaggtgctgagccacaggaggcctgtcaactgctcaggtggaaggtgtgggaggagggaggaggcaagctgtgtggaggagcttgaatgaaaggccaccggctcaccaggggagacaggaaatgagaggtgcctactgggaatactagagttcagagaacttcatcaagaaaaggaacgaacccaccccctccttgcatcttcttacctgcagggaagcacatctcacagagagtacatttctggcccagggattctaaataaataaatgctaatgtagaatgattcccagattgagttctgcagcagaccaccaggtcttccagagaaaatcagcacctctttgtcagttgctaaggttctcagggaacggccaccctccatccaccctttgtttgccaagattctcagtatgacagtgacacagtgacatctcccccttaagtttccaaaagtcctggaaatactttagtagggactgactagtcagtgactgcatctcactctttcatttatttactctagcatttgttgtggctataagccaaatcctctgctttgcattagagatataaaaagtcaaataagacataacctctgttctcgaggtgacataaaagtaagtaatatttacagaataagggtatatgacagaaatatatccaaggtgttgtaggaacccagcggaaggagaattaaatcaaatgaggattcggggacactttctagaagaggtgccaccaagttgagtgttaaaggacaaaaataaataagctgaaagagaggtttagggtggggagggagagaaagggaaagaaaggagaagtggaaaaagttacaggtagtaagaagagcaagtaaaaataactggaaaagaaatagtcgattccatccaagaagaatgagtagataagtagaactggacaacaatgcatgcaggagaacagcagacgatgaggccagatcacaaagggctctgcagtccaaacaaatacgtttgaaatcgactctgaaagcttcaggaagcccccaagtatcatgcaacatcgatatccaagaccaaggcctcagaaaaattaaagcctgctgattttgaaaattgggtttctcaggtttctgtaaaggttaacttatttccaactaaataagaaaaaaacaagattatttcagattcatagtcagccttagctctggttcctgaagtaaaatttctcactttatattttgccacttggttgttaaatcttttgtgaaaccatatacatatatgatcatgtatagcatatatagcacatattttactaatatgtctttaaaaaaggatgcttgccatagtaaataaacagtaatatgatattaaaactcaagtaagtgccaaatattccttttctggaagggtaaaattttaaccatatattcccaatatgatttactttctcataaatgtattaataaattgctaattacacatatgtagtgcaatactaatgtaataaatattatctacatagtaaaacatagaaaaagaaaattttcaaggaatagaataaaaataaggaaaaataaaggttttgacattttctatttgttcttcagtaagtcatcattcaaacctatgttggaagccccctacttacttagacagctaagacagatctacacccccatgcctctgtgctctgtgcaattgcatgtagatgtctgtacacctttcattaaaccaaatcaactaaaggaagaggaaaagagataaggagagtggtgaggtaacacacctgtggtgggctttgtagccaataagaagctgaggcaatagagctggatgggagaagacacctgttaaatgaagtttagcctgaagctgcctccttacatattttaagtctggcttaaaggcttctctgcatatagttaattgtaacctaactagatatgtaaacagactgtaacctactcttgtgccaatcacagagtttcagccagtcaaaggcgaccaactgatcaaactgtgtgcaaaaaaggcaaatgctaagctgtaaccaatctggccatttctgtacctcattcctattttctgtatatcactttcctttttctgtccataaatcctctgccacatggctgcacgagagcctctttgagcctactgtggctcaggaggctgcccaatttgcaaacggttctttgctcaattaaactctgttaaatttaatttgtcttaaggtttttctttgaaaatacccttccctccactccctggggtcaatgtgagggtgaaggaaaacataaattatgaaccaagctcttgaccctctttgtagtacatgaaaagcaacctggggtgaaggcagggatagatacaggacgttttatccgaggagcaagagagagtcatggggcttccaggatagccttggccccagaagttctttcccatattaccagaactctgggatcttagggacagacttgttttttgaggggttttttttcccatttttctctaggagcatttagaagtcagcaatttgggaaccactctacataaggtatgtgcctctatttccttactacaggtgatcttgctaaatgtaaaccctattcacaaaatgtgtgtcatcataggatcttgcccacttctcttttccgcaggatttagtaagaaaaaaaaatgctattgtggtgaagattggaattatcaatacctcaacctatgggaggaaactctgctgtagacacccatccccctagatttctcaagaagaaggagctgccacacactacttcctgccctatgatatactgaggggagagggaaggggactggtgtgtcagtttcagagttttgattcaggactacagccgtgtccccagagcaaacaccccaaggcattcagcctcactatgccaacagcaatcattcctgctgatccaacacacgttcaccgattatgaatgaatgagagcggctgggatttaatcagcactctattcaatccaccatgcctccatccattcattcactcactcgctcactcctctaacaaataaacaaagaacttctactcttctggagcttccctggacacaggaagcacaaagatgagaaggccccattggtgccaataacattctggaagacagcagagaagtgcctgccatttgcaccccttgctgaccacagcccagacagcctgggcagagtgcagaacattcaccacctccgtgcgtgggctatacagacaccatctctccacacactactgctgcctgaaaaatgcagtcagatgggttgtcattaagcctgacaaaaacccagcaccatctaggtaagagcaatgttttttatccagacactaaattgcaatcaggttacgttatcatgtaaataaagaggcaaacagatggtttcaaacgagatccagggctttcagagcattgccgatgttacaaatgaagaaaagcaaggacaagccattagacacagagcgggccccggagtgcacagcagcccaacaaacagaatcctggcctggataatgcagccaaaacaaaaggcagtcacttactgcttgcaattgtttgttaatcaaataccactaatttccaaatctgggcaaatgctctgagaaacatatattcatactttttccataaaatatattttgcaacggtgtcatctgtgtatatcaccatgacccttaataacacagctttttaaaggctctgttttatttcctcccacatgtttaaataggaacagtgtaatgaactagacagactcagggaatccagaggcctagatttgactctactgtctctgttatctctgagctctttcttgggcatgccctcttgcgatcatttccctcaactgtaaaatgtgaaaacaaaaaatgtggccgaggccattagctgcttcccagtatttattttatcctcccttagtaataagaactccaatttttagctgaatagtttgtcacctagccaaaagactacatttcccagcttcctttccaggtagaagtggccacgtggctaagtttacactattaagatgtaaacagaagtgtcatgtgagaaataaaagaagaatcctttctcctttctgctgcctggaatgcggctgcaatggctggtgctccagcacattgatggaccaccgagtgactttggaaatagaaaaaacactggaggacaaaaaggtagaaggggtccaagtccctgacaccatggaacagatttttatgtaagagagatgtaaactgacatatctatcaacctcgtaccataataacaatttttaataaaaataataattttcagggtttttttattcacagaagacttaatcttcctaatacctggatacccaaacccctaattcttaatacctggacaacaaaactcccagaatggtcgtgagtgttaaattaggtgtgagaactctttgtactcaaaatgtttccctgaatcctcagcatgataagctgctctgtgaataaaagtgttacacgatcaaacatgctggagaacagctggtactatatccccctccgaaagttatacaacccatattgtcatataaaaggatttgaaaagaccagaaacaaaaaaaagtatttatctgtgcttagtccaaaatttttcaaatttgtttgacttacttttttttccatgtgatgcttacagggagctagtttcagaggaaacactttgagaaatcctgggtaaatttcttaccagtaatagctaatatctaaattgttgcttttagccttcaaatatgaattgtaattgaatttacttctatgccagtccaggtccaggtcttacagtatatgctttcattactctctgaatgtttcctatagcacatttgttagtcgtattcatttttaactacatgcaattacatttctatctccccagctaggcagtatgttccaggtgggtctcagaactattttgctcatcattttatctccaacatgaggcaaagtggcacataataagttatgcacccagtaaatagttgctgaataaatgcatgatttctgaactctgttttcatatcacacattatgcaaacagcagtgatggaatacatgtaaatcaattttggctttgcgaggggttttaatctcttttagctctcttggatggcatttggaccattagctccaccagtgcctatgtatatactcttaatgaactgaacgttagaatgtcccttctaagtatcattatttagtaaacataagaaatcctgagtaacattgacctaaaaataaaataggagatttttaacgtacttgcagataaagaaaatatcagaattctcaccaagacccattactgggttcaactggtctggatatccaagatagatcacttacatagctggaagctgagattggctcttggctacagcttatctccatctggggctgccaagcagtgcacaaaaatgacctttccatatgatttagattcccatagcctaaggtatgtgttccaaaaggaaacaccccaatggcaaatgagacttctaggcaaaaggatcttctaatgcaagggttcttgtgacctagccttcaaaatccaagaacattattctattaatacagtctgtcagtccatctagtcacaaaggccagcacagattccaggggagggcaggaagctctatgtccctatagaaggagcagcaagcatttataggaaggaacaaaatttatggtagccctttttggagaatttctgcaataatgacattgaaactacgatacctattagaaccagtgctaggtactgttactcaaccttctaacagaggagcatattatatcacattttattttaatattttgataaccataacaatataactgatttcttttataatcctactttattttatgtatcaaaaaaattatttagagaatgggtctaggctttaccagactgccaaagggatctgggacatataaaatgttaagaacccttgagctgcttaatagtgtggtaacctaagggtcagcaatgagccaactatgccattcctgcccctgctggcctgcctgtacctacaaagaccttgtcacttcagcaaagttcttatctctaaacctctgtacatgaggaaactccaaaagctccctcaagggagtataatcaactcaagaaatggcaactgtacctaaaccaatgattgggaaatcatgaattatttaattttacattccaaaaatatctgcatggaaaacagaccataaagagaaaaaaagtaattcaatgagaacacgtgaaaaaagccctgctctgcattaaaaactcccacgggcagctgctccttgcttggcttgtacttcccaaccccaaccaggggggtaaaatacatatgcaatcactcagtttcccttcttttgtaagaaaggccttggtaacactcctcaaagaatattaattccatgagacaaagttcttagggcaataaaactaggtaaaatatgtttatgcattttaatcaggggaaatttttattaaccctcagcaaacttgttgcagtgcaaatcatagaatatggggttggcacaaactttaatggtgatttcttagtagggtgacccaatcattctggtttgcctcagacttcccaggttttatcactgaaagtcctatgtcccaggaaacaccctcagtcctggataaaccagggtagcaggtcattctctttaccaatgattttaaagacattagttcctgatatttatgtctccaaataaatattaaaacctatggatgccactgtcggtattccagaactgaaaggaattaaccaattagctctgatagagtaatgttgcctgttttaaataacatggacttcaattcttacctccaggattgaactcattctaagagttatacataatctcctaaattttaaaacaaaatatattttgtattgtgttgtgtttttgtaatactctacttttaggaaatgacagggattcagtgatttcattttttgtttgtttgtttgtttgttttttgagacggagtctcgctctgtcacccaggctgaagcgctccacctcctgggttcaagtgattctcatgcctcagcctcccaagtagctgggattacaggcgcacaccaccacaccaggctaatttttgtatttttagtagagacagggtttcaccatgttggccaggctggtctcaaactcctgacctcaagtgatccgcctgcctcggactcccaaagtgctgggattacaggcgtgagccactccacctggctgacagtaattccttaaatgacataacctattctattttccaaatcaagctgattgagctatacacattaaccagtttggtgggactgagcctattacctgagcctattaatttagaacaccgggcagtactgtaaccagaaagtgaccagggacacaacctggctgccaccttaaaagtctgctcatgggcagtaatggtttttaattttaacaaagatatgggtatccttgaagacaccgatacaatccagatgtgtgaaactataaaacaagcaagagatgttacattagattttgcatttaattagtgggagcctgcacagaggatatagtttattctcaagcaatttccaaattaccatcctccttgtcctccttggaaaatttactgttaaccacctccatcatcgtggtattgctcctttcctgccttgccttctgctgtcctggttctaatttcatgactactcgttctatgatatctcttcctgaaacttaaattagcattgccctaagatgctgacttctacccaatccttatatctctctgcaatagctctcatatgagtcctaacccccattcaatactcaaggcttccttagtcaattcttctgagaattaccaaattgcaatccagattctcaattggccttcctttcaatcttctggtccacatttcccgttaccatctaggcatctgcacatgaacctgagtatatgactataatggaatttattatcctccctgctaaacctactcctttacatgcatcctctatttctattgatggtacccctaggcattcacctgtgtgcaaaagttctggtcatcttctcagctcatttttctttatttttttacaatcgataaattgttaaccctatcaattctgctttcccatcaagtttatggtacttattatatttttccatagcagccatcattgcatttactgctactatatagcttgtaatttgtattgttaaggtcaaagtatacttgaaatcctggggaaagtaatgcatagtttctttaagaaatagttgtaaactgctgctgaaagtttgtacaggttaagtaagagaaagaagttgctatagtagcaaaaaaaaaaaaaaattatacctattgcaactaaaggaaagcatcataggtgttttacaggaatacctgctagaatcctctcaggctacaacagaaggtgcccaatacggtcacacctctgggagactgaggtggagtatttgaaatcataaaagtagttattctctagatgggagcacataccaaaataaaacccgagtctcttatatacttcatgcttgccaattaccgccaccccatgatctttacatcctggggacgtgtgcccctcctagaaaattactatgatccatgatgctaatgctaatggaccatgacaatgagtgtgtttctcaggtgagtgaaaacaagaaaaggtttgtaaaagtcctctattagagtaaaactcgaattagttccagcaagttagcaagccataaagagtgtcaaggcctacctgactttggatcccaagagtagaccctaagtgagttctaattagccagaaacaaatgccatgactgattcaagcagacatggacaaattaagattggaaaaagaatctcaacctatttcaatatatttatatttttatgtttattctgtcacagggaaaaatgcactgctattttaatcgaaatttcatttttatgaagaaaagcatatatagttgagggaaaaattctttttaattcccactcctaattgtccaccctggcaaaagcactgtgtcacagatcttggttagaaagtttaggggactgctgctactcatttgggagcatccgtttgaatcgtggtcattgcaactagaaggaactccctagcctcaaagtgttttgtctcaaaattcaatcctattttaggaacaaaacaaataaatcaatagtagtccctttaataaattttaggggtcaacttaaaacactgggttgaagcatggggactaaaatttcactcagctttggtataaaacatcatataagtttgggcaataatcttaacatatgtcatagcattttacaatttataaaacacattattatttagattattattagttggattagaaagccactacatttcctgccaaatcaacaattctatgtgtctataatttacatatatattaatatttataagtaaatccacctcaaaagaaaacaaataaattactaggtaatcagttcatcaagggactccatatagcaaagcactttatacttagactgctttaaattgtaagtttctatagtatatttttaaatgatttgatatatgaaaagtttatttacattcatcatttcaaagataaactgcttggggatgttggtgagaacacctgctctgtggagtctgaaattcttccttccagtggtgaggacacgactttgacatccttaaagcaaggttcactaaggtctatgattctctctaagaaattgcctaaaaggaaggagaaatagacagtttccaaagatcctttcatctttgacttcaggttttctttttatttatttttattggaaaataatgttgattaaagtttttaggtcaaaagtagcttaaagaacagcttttccattcactttctaaagaaggtcaaaggaaagttcaactgttgtctccctggatctttaatgtctaccctgaaagaaaatgctcgaaatatgtttccttcatgtctttcctcatcccaccatatccctctcttctaagaagaggctctggtcacacatgtaaagatttgaccacaagttgcagttcaacaactaccgtccattcccactgcaaagtgagcaattccaaattgggggcccaattatgtttggagagttgacaaataccactttcaggcagagaagaggtggtgtaattaacactaagcattataggtaaaaataaaataaaataaagaaactaaaaccctttgaatagtctgtctcctggtgttctgtaatttcttattcatgcaagccaacagagtctaaataaagtctgtccagacagggaagacagcacaaatttagcaggctctaaagcactttttgaattaagtcaggtacatctgcttttaattacatacatgcatatatgcttacacacataaacacatacacagaggtagattaaagacagctgcaaattcttagctattcctcctattgagaggtggaacctaattcttctctcctaaatctaggctgacctcaggaccttgcttgaccaagaagttgatggccatgatattctgagcttgccagagccagcttagaaggcatgtggcttccacacaggtctcttggaccacttacttttggaacacctttcttaggctattctttcttggaatccagccatcatgctgtgaggaagcccaagcagccccataataaacccatgaggagaggaactgaggcctcttagttgattatcctaagctcccagccaataaccagcatcaaggcccagccatatgaatgacccatcttaaaggcatctaaaggcagccaaggtgagcctttcaatgaccacagtccagccactatctaactataatgcatggaagaacccaaattagaacacctcggcctcgcctttccccataaaattgtaagcaaaataaaatgtgtgttttatgctgttaggtttctgggtggtttgccaggtaatgatacagtttcagaacacccactccacttgtcaccattctgatgccacacattacaaaaaggaccccagtagctgaagcccaaatttcttcccttcccacttgctaatccagaataagtggggtggtgggctttactgcttttatgtcccatccaaaaggtacaagaccaaaatttgagaactacacaagctatagaaacatcaccaatatttgtttggtttctaattggtgttgtagacctacatctctgctataattcagtatgaaatactgaattacatataatctcagataagaaaaaggtgaatgaagtcaatagttttataatcacaagatttcatagaattcctcccctcaaaaattactttctgatttatgatcatcttgcttcatatcaccaacctattatgatcttttgcaatttaacaaggaggtgcattacatattgccatctttgaacatcacacgactttgataagcttctctggcatttaaggtactgaatattaaaaatcagaacaaacagaagagctattataaaagaaaaacagtactctcccattcatgtcttcaaataaggacagttcaaagtaatatacaaaatgtaacagtgaattctaccacacacataaacacacaaagatgctggaggctacatgatatcatatttgcacccttcaaaacagaatcctgagaaagcactggaggcatcttacacaaatccactctggtcagtttagaacaaggcatagagcagaagctagagggatcttttgccatttgaccagctattctttatgaaggtttgagatttgcgtagtaaggcagaacttgttcctactacttaagaagttgagaatgcattcaggccaatttttccaatatttagaaagcaaagacagtcagatacacttacttgttgaagcaaagttatcacgaacttaaactacaagagcaaattcttaatgattacctcagcttactccatataataccacagagaagaatttacagttctttcaaaatccaatgtccataaagatagaacgccttgaaggaaaatggtaccatacttaagatagtgatgtcttttattagtacagtaaagtcctatttttatggaataggatgggtctgaggtcattccataaaattgatttcccagaaaatggaaataggcaatttaccctaagaattttattgaaaaattatgctattctatttgaataatgatgggaatgttctacacgtttcctttattaatgaattaaaatacacaaaacaccataaaattatattagaggttcaaaagtatcacttaaatcttttttaccagtcactttcattttgtaaaatcagcagttccattaaaatcgtattatgtaaaaatgggtttttactgtaataatagttattacctatttagctcccaaggatgttgtgaaaattaaataataagccattggaaagcaaatacaaagtgttgctaataccagaggccaagaggggcagccagatggaaaaatgaaggaaaagagcacctgatacattacaaatcacagctttcatctgtaattccattaccgccaaaactctatgcgttggtcatgtgcactgatgttatctcatttcatctttcttaacattatattaattatagccctaatgttataaataaaggtcagaaaggtttacagcttgtccaatgtcacaccgttgtaaatgtcagaagccaaatgtgaaccccaggtttatcctagtcgacagctcatcctatatcctgaaggatccccaatatacccttgtgtctcataactgcccctctaattcttacctcatctttcaaaattcacttcaaatgcctcttcttccatgaagccacctttaccctagagacactatgattctaaacacattcagtatttattatggctatttgttgtattattgtgcattatgtgttttattaacccagcaaaatccctggctggtcacagttgtatggaacttgactttgggttcccagatcatgagcgcttggaactgtgccttgaacagagtgaatgtttggtaaatatttgctaaactgaactggaaaggggtgttcatttgaattacaactacatctgctaccagatgcaaagcaaatgcttttactaatggttcattgcattagaatggttctaatgcaatggttcattgcattgcatacctctttgggaagtatctccagtttttccaagcatgtgtgataagattaaatacctcaagcagtgtatctgacatacaggagatactcaacaaataatagttttttattttatttttgttttatttcaagttaagaatgcggatggtaagagaagaatgtggaggggcataaattcagtataatatatagtctaatttggagatatcagagcaggtattgatggtaagtttttttgaaaaaagaaagatacaatgaagagttagaactcttgatttaaattctctgatttcctgcaaagcttctttacttactggctgggtaaaacttgagcaagttaccctctctgcatcccagatttttcatctgtaaaaacagggataataacagaatccacttatagagtggtagtgagaattatatgaaaaaaaaatccttgtaaaatacttagtatggtgcatgtcacacaccaagcactcaagttatagttgctactatcaccatcattactatcatcgtaaaaatcatttcataattcttaggaatctattcaaaggagaagacatttttttccacagactgtaaaatcctatagtggtatgtgtcaatgctgtcaaacacaaagatttatttctgctattgaattatggatgggagcaatgagttcatgcacttcatccaaatgatgcttactgaacgtctactttgcgccagagtcaggtggacaaatttatttgatttaaagaaggctaggaatgaaagaaacaaggggagccaggaaaaggtggagagttcagagagagacaaaaccacaagcagaaaacaaaggtagattcaatccagagacccatcagaggtcaaaatatcagcctgtcaaaaatcagaagggaagagtaaggccaagcagctcctgcataagaccccaatccaaatggcacaatgaattcaatcgctcatcaatcacagatcattttttggagatagaagaggggttattagacaacaggagagggacaatgagcaaggattttattttttatatattacacacctgtttttcactcacctgtcttttcatgtgaaggctagaaataatgaaaaataactgtgtatgttttaaaattcttaacttttctgattatcacaataacactgaaaggccaactggaaagtcctttctacatccaatgcctgtgccccacctcctttcccccacccagcattgatttgtgctatttaagagcagcttcacggagaattcaggcccatcctatgatcttatgagctgaccatagacaaaggaatgaagaatagtggagaaagccagggatcccgggacccaggacacacagtggacacagtcaactgcagtgccaagcaaaatggccaagattgctccttgctcggcataaaaaccccaaaggatactaaaagcttggcaaccttcaaaagcttctcttgcttcctgcatggggtgggggaagcagcttgcttagtgggaaaaaccatagcccagggtgaatccgctggctagattcatcaaagagatggctgagacagaacagatttttccttttcatataggaatgactcacgagcttgtttattcaaaaagttacatcctccatcaaagagaggtggtttactgggaagtgggatgataataataattgacgtttgtactggtcagcccactcacacctgtccctcgtgtctctgggcacagttacacaaacacaccaccaatgataagaaggtggccagtatatcttctttcattcttccttcattctgccacacaaataaagcaaacaatacagtgaccctcctttattttactcgtagtcattttagaaagggaatgtgcgttattggttcaagatgaggactggaagaaagactgcttgggttcaaattttgactctgcaaattgcaaaccgtgggaccctgaacaagtgacttaattgtcctgggcctctgtttctctgtctgtaaaagtggggataataatattacttatttcataaggttattgtgaggattaaattagttggtacatggaaaacagttcccggcacattgttagttctcagtaaatgtttgacattatcattattattacttcacagatggttaaatgttcttccattatggatcttcttttattcactattatcttaagaggttcaaattaaaccataaatgtaattaggtctttgggggaaaatataattgtcctatgaaaaacattttcttctcaggctagggagatattctggaacttttgaaaactctcctttaaataagaagattttataagtatggctgtgtgtttctgtatatctaaggaatcatcttttttataacgtgtatactggaagataggtctagacaaacagatgaatagatacatagataggtatttttctattttattaacctacttctcggcaattttcaaaactcatagcaaccgaagagcttgtcatttttcctcagtcctgtatttcaaaattcccaaaggcaaaccatcagaatgcattaataaattgttgtcttccataccctctgtgtctttcaaacttaaggatactagaacctgtaaatccattctctgacacatgaagaaaattaaccagttagtggattattttaactcctttcagcatgacaattacttattccacttttaatgaagatatgctaggttaattttggggggatttcactggtctatgaaattgttctcctacattaacccccccaaaaagaggaagaatgaaacaacataagtgcctacttatttccaaactctttactgtgttgtacaatataaatgaaacataatcagatctggctgggttcagcctgtctgtgattcatctcttgggtagttttactcactgggtaaaatgagaacgtcatccccagggcctggaatggtattgttgtatcctccccagccttcttcaacaccttgccatgtttcagggagggaccattttaaagctgattcaggggcagaggtagaagctagaaaataaaaaaaaattttgaaaatctaatccattgtgataacttccaaattctatccttattttaggatgctagtggtattttcacctcccaaagaagctgcctatcaatattttataagtttctgtacaaatatttatcagttaaaaagcaagtaattattcaatccttagattaccttcacttctgaaaaaaatcccacttttgttattatacatctgttttgccttataataaatatggcatgcttatcatgaaatatttaaaaaatgcaaataagaaaggtaataattgcccataatctcactaccttgcaataactaccttttatttctgtttccttccagaatttctcagaatttttacataattgagattatatcaaatcctgttcttattttttacacccagttctacttttgcttagcttagcctattttcctatgcattttataatattatttaaatgccttgtaaacataattttagtggctacatatcatattttaaaaatccataattaattcctaatgtctgacattgagactctttctattctctgttaaattgtaaataatgcagtgttaactgtctctatgcaaatttctcaataaccctgattatcttcttcaaatacattcctcaatggaatgactgagtcaaaggtgatgttcttcccacagctctccctacacattaaaggcggggtaataatctaaaaacttctcagggtggtaacttacagacagatcataccttccaaccagtttctattgattctgcctttgatcgtcaaacggcattttcttttcaaccattctgctagtatctcatcgcataattgaaatgtaaatctaataatttccaatggggactgtccaatagcacatcacgcacaacaccatgctgaaccatatctacttgttctttcctgggatgtgattactggtacagagttagaagggaagagagattgtctcaaaagggtagaatgaaaaggcctcctcttttgaggggagggagggaatcatgtccatgatttgctaattttacaacataaatagtgagcaccttctctattagaactgcccttaaaaagtagggatacaaaaagaaataacatgtcacccttgcctccaaggagctgatagtgttatatcagtattaggaggataaaaactctacacaggcactgaggggagttctttttaatggtacctgatcacgaaaggaagcaagattttgccaggagaagcttcccgagggaagtagtaactcagctgcattttaaagccttagaagttattcaggtaaaggggaggttgtgatgagtgtatgacaagagggttgcactgcagacagaaggatgagcatgagccgaggcaaaaattgggaagtcaagtggaggaatgataagaaatttggtgttgctgaaccacagagctagaagagaggtaagtgacaaggttggtaaaataaacagaggccagagtatgaaagataataaaggtggagggtccagagacttccagcacattaagacagaagtggatgaatagtttgtgccatagggcattcagggtatctctgtggtctccagatggagctatacagcaagcagtggaaaaatatgaattggaaagatgggaagagctctgagcccagagatgaatttggcatcatcggcctagaagctgtatttgaaactctgagggtggttgtaatagctccagaggatttcaaggtgacaagggaaaatacctgatatcagaaacatgaggaacacttagttattttttctaccagacccaattcctcagtagtcatggtttaattagagacccaggataacctaaaagtatatagattgtggtcaagcaaaaaccataggcaacttaattagtacaaaatataccacacaccttgggaataaggcaatgtcttggaataagcatcactcagtaagaggctttataaatatttcataaactccaatactgtaatacctttctaagttttttcccaatgttgcctgcttcccaacattagacccaaaatactcagctgggggtagagtaaggggtatttgtcagggtgacccctagcttgccccacaaagtccagataaaatgtctctgatgcctcatttccagtgatatttcaaacaagcaatgattgttctctaaaacctcacgccaagcttcaggaatctttagttactccaattttatatcacagatgatggaaacaaacattctgtacttttttcacctttactcttgcttataagagggctgacacagtctttagttggacaaattaggccttaaggtagctattctaatgaaggaatgttattatgtacaaatttaattattctataccatcctgcttaagataagaacactaagggataagaaaacatgtttcagtctcctgtcagagttatcagatttctatacaactaatatcagggttctatatgactattattgacaatcaaatttgtggagagaaaaagaagcctacaagagttaaagaagcagcagtcagagatctactgggagaatcagaagagaggaaggtcttggaatcctaagtaatacagcatctccagagagcacaagtgaccttgttaatagtagagttctggtaagagagagaattagaagtcactgttaaacttagcaatcaaggcatgggtgatccagatgacagtggtcccagttgagtggttgagacagaaaccatattacagtggattgaggaatgcactggaggtaaggaaggaaagatgttgggtcagaccatccaaaaagctcactgaggaatggacagtcttaagagttgagaaccacagcctttgatctgtcttctgaagctttagataaattagactagtttcaaaactggagcccatgaattttggtctggaccaacactcctgatgaggcctctccttgcttccctgtacaaatttgtccctcaacaagcacttaagattttaggtagtctcaagtctaatacatgagccaaatgttggcctccacacctttgctcttcatcaacccaggttttcatggctctgcatgaagaggaggctaggcttttgagaagtttgcaggacagctgtctgctaaaggaaaattcagtatccacaaatttgttttgtttttaaatgggaggcactgaacagaagaagccagtaaggaaagaaaggttaactacacgagacaatgagttgttcgctgatgggggaaagtgtggaagatgcaggaagggatgagttaactttgaacaagactagggctgcctgattctcagagatcaaagaaagcgacaaaaacttaggtctgtgggaaaatttaggaaaagaatacccgatgatctggatgttcttatatgaccatggacaatatgtgcacttagtacgggtacatattacatactcatatcggttaacacatagatagatggttaactcattcaaacattggattgacccattcaaacaatggaatgaatgagttaacacagatagatgtgttaactcattcattcattcattcttagttttggcaaaaacgatattgcaataattttactgttttacgtagagctactcattaaacaaaatacattaccatatttaaattttggcactagcacagatactacatacatgagaatcaggcaatgtcttgaaagtatgttatttaaaatttcctcctgatgaaggatattgtactaaatctgtaactctttgtgttttgaaatagttttctgttcccaactatatgaggtaggaaaactggctagattttaatataactcataaattaatctatgctcaataaggcaatttaaacacattagaggctacattgtatagcacaaggaacactgggctgagttgagacatctgagttcctatctaggctcatatgactgactactgatatgactaagtttaatatctgggcttcacatccccatttgtaaaatgaggcaactggataggatagcctgcaaggtctccacctttgttaaaacccacaactctatgaagtatgggctttctatttctcagcagttgtaattgacagttgtaatgcaagcatctccagttaaactgaccccttctaaaaagctctgaatgttccttccagagaatccttagtacagaaatcatcatactacatgctgagtgacatgccaccctgactacagatggttgaaccaagaatggccattcatagatggtccagtatccacagaagggggcctggcatgagagcttccccaacaggtgtgtcctctacagaataggcactgacacagcaaatcaaatctctccttggagaatttgaacatagaaactttcaaagaagagaaaactatccttttccttataacagtaatttttaaacaactgtattaattgattacttagtagtttgactgacatccccaagagatcataagaccccataaagtcaaagttcattccatcttgctcatcatggtatcccccacaccttgcataaaaggcactcaataaacaaggcattttgaaccacctaaaggcaaagagagatgaaggacaaggaacataaaaaacaaagtgtggtggcagctcagaaaacattctgaaaacaatcttgaatcacattcttcatagtccaataagcatggagtagtaaccttcaggattatcatttatagttttagtccagtcctcttacctcatttacctattaatttaaacagaggaattagatcattttctgattagcatgggctctgctctgacatagcacaaaaatgccactgaaaattaaaagaaatctctgcgtttgaaaagatttattcctcttgcaaatgtatagttaaattgactcagaataaacaaaaacaaacaatgaaatacatcagaaggtgcttaggagacatttagtttttgagaatttggctttttgagttagaaagatttcatagaaccatctgacttttgaggagggtttgtttaccctgatttcctgaaattaccaggaacaattaaagtttagagataccctgaatttttctttccatttggagggggcctaatagcccatctgcagatctggagtcctatgtgcacatatggtccataatttatgaaatgtgcttatttacatgtttcaattcttactttcattgctttgaaaaataaatccacctttatatccttttttgacatgcagatacatattttagttacagggcaacacaatagagagttatcagacatataagctttaggactgatacctgcctgtttattaacagtatgacaaggtggaatttgtagaactactggaggacattctgccatactagacacttctacttcgtgtgttaatactcacctgaaatagttgggggcataccttccttcacccggagaatgacttgaacttggccttcacctgaaactaaataccaaaagccacaacttgcatgtgatacaaagatcatcttaatattaaagacagtcacacgtgagaaaagaagaatttatgctaaattctagttgcctaaattttcaaaacagaaaaatgaaatccttgttagttaatctaacaattgatttccaacatttgattttgattgctttcatttgattaaatgtaattgcaatgaggtctccaggagaactggcacataaataattaggagaaacaaaaacagaaacgaaacctttagccatatgttctaaggaagccaatggtgtccagcagggcatatacctcatatcctattttctcttcatcattttgtaggctcagcttttagaattcatgtgtttttcaccaatagagttcagatcatccatgaaatgtatttggttacctttatccaaacaaattgtccttttaatgaagccttttccccaccccctatcctcctcctatcatccaagccaactgagcacatttaaaaggcctggggttcattaattttaagcgttcaataaattagtggaaataatcaaaaggcctgattctttctgataatgacaatttgatgtcaggataaaccagtagattaagctgggaacatatgctcctttgccaagagaggctgctataattaaatagtgaatgcatctacaaggtgctctcacgcctgattaattagtaatcaggtgcacaaactccatttttcagtcacaccttgtctcttattggttaattacctttctgccttattgtttgtcacatgagccacaccttccaccactggagcaccccttgttgctgaaggctgcagccttggggactcggccaaattcacattctccacttttgttttcctggaaccctaaaccctttcctccatcagatgaaataaacacaggatcattctttctaaatataaaacataagcagccaggcgctgtggctcatgcctgtaatcccagcactttgggaggctgaggtgggtggatcacttgaggtcaggagttcaagaccagcctggccaacatggtaaaacccatctctactaaaaacacaaaaactagccatgcgtactggtgcactcctataatcccagctactagggaagctgaggcaggagaattgcttgaaccctgcagtgtggaggttgcagtgagccaagatcacgccactgcactccagcctgggtgacagagcaagactctgtcttgaaaaaactaaaaaatgaaaaataaaaataaaatataagcctcagaatattacaaagaaaatgatccccaaagagatccatgatgagacctcttcaatttctctaatcttattttggtcattttctctttttaaaatttttctaaggatgtaaagcatgagtttgtgtctttctccttacactgccacatgttgagacctggtacaatgacaacatgctcttgacatgttctacctttatcaccacttccaagactttgcttaaattgttccttcaccctgttgcttatttcatgcatctttctaacttaatactaataataaagccaccagtcaaggtgtcatttcctttttttaaaataaggtctaactcatccacttctgttcacgttgatttgtgcattctctaaagttctaaagtacttctaaatccatcctgtgatattcatcccaaacttgttctcaatttaataaatatttattaagcaccaactgataatttaagatttcatcaataattagctttgtcttcaaatttttgagagagagatttttctcatgcaccttatgagaccagatattgctagaaatgtagatacttcattttcatgggccaatttagaaatcctaggtttaatcttgtatctgtagctctttccactacactgcaccaatggcttctggactgagtggtgaatgattttcttaaacctctacacacgcacaaatggtccctacctccaggagaactccctaccaaaacagacattgcaaaactaaaaaatatattgaaaatctgttgctcacttcattaacgttgagtgtgtgaatgccagtcagtgaagagaagtagtttcaggatcagaacagatacagaaaagttaacaaaagcaggaaaaattagaagtctgatttcctataccaccatctacatgcatctgggggcagatgagtatgagacagagggctatctcttcccaaacaccatttcctggtcatggtcatgacaatagtgaatggtgggaagaatgtgggtgctggagcccaacagcctgaatctgaatcctggctcttctggttcctagacatgggccactgacaagttatttgccatttctaaaccttattcatttcatctaaaagtgggaataatcatactatctatctcatatggctattagaaagaaaagatagaatagtccatggaacatgcttagcacagtgcctggcacatcatgaacaataaatgttaactattatcaatactgtcattatggcatgttcatgattccaggtgccagtcaacaaggttcaagaaacatgcttttactttctactctttttacagctgtatctaatcatgatgagctgtagtattacagagttgtaagcaacttaaccagatctgctaaagtttgttaagtgtgttgactctacaaagaactgtaaatgtgaagtgtcatttccaatttgaataaatacaaagagggatgaaaatcatttgagaatgaaggtattgacttgggaagagtttaaaagccttacacaagctgtgatattgtacatatgttttctcagtgcttatgatttctgattttgtatttgtaatatgagaatggttaatcttccgtgtttataaatggagccccattgtagttgatccttcccagattgtaagaagatctgatgctcaaaaagacaaaaaaaaagtctttgggccaattattgccaactttttctgacgagtgctatgtgatctaaacttgctataaacacagacatctagggtgaagaggaaatgtgctaagaaaatggctcctggtaagagaaaagagagttactaaagtagatgtgatacgaggtcctaccaggttaatgtgttgtgtctgaagaactctatcctcacttaaggctctaggaaacagaaaaattaattaattctctccctaaccaggtctaattctctcttgaaattttagagggagaaataagcacccatttatttaaaaataaaaaacacatggaatcttagtaggttatagactccttccctatttcactctttcattcatattctcattctcactttgtcgttttagtttatgcacatattaggacctctcactcaggccacatttatctagtgtgtcagccactgactaaacagtgaaagaacataaaacagcaactgcaatcagtgtctgcaaatgtcatgcagtcccaccctgactcatgacttctctttccgtctctgcctgccctggacccaagccccagctctgtcttcttgtgctggctgttggctctctctgcatttttacctcttacctccacaacctctctgttacctcctctgttgcctccacatcttttccctgtcctgactcacaaatctgtacactccttctattcctcctgtcctgctcagtgaatttgacctcattcctcagaagctgacctctttggcttagccacagagaaggcttgcttgtcagttagtccttggcagctaaagcttgatttacaggaccacactcctgtctgattccagcctcagaggcagccacggaaggcatcttggccctcataaaacatgatcctttaaaggcgttcacagaaatagtatatgaaaatcctgtgattacctttgagtcttctattatccctgtatcattcacttatgaaacagtgaattttgggggggacaaaaggaaaagaacttgatcaagacaccaacacatatatctgcattagccacaatcctgaaagttagctcaattaaaccttcttaattaactcagagaagaataacaattgttattctgactcagagcaatgtttttcatacttctgtggaggtatttgtgatttcccagaccctgccacagacctacacagcctgaatctctcaggagggtcctgggaataagcatttcagctgtttacacaggaggcaaaaaaacacaaatgtaaggaactaaacaaattttctcatactacactcttaaaatattgtttgttctcaggagcaggtgttcttaccaagtaaagagcgagacccagatggaaaagatccttacttcacaattcgtactttttatcaattataccaaacccttacagaccaaatcatattcccaagatgttaaatgcacaatggttactttagaggcataaaaagtttcattttagtatctatacattgtaaagtattttagaaaaaaacaactaacccattaaacccatgatttcatggatattattaagaaaagttaggttttaaaaataagacagtgtagaaattgatttaagaaaaatattaagtaaataatcagacaagaggtataaggatatgacacaattatgaaaatggtactaaaatatctaaagttcaggaagcacagtgttaactaagtattgttttttcttataaattgaaagaagaagagttggtttaaaaggttaggtatataagctcagatttaaaaaaagaaaagatggtatactagaaaaagcactgaacctagagtcagaaaagctatttgaatactggttgcaccacctatgacctgtgtgaattaaggctagcaactcagcattgcggagcattaactccttaacctgagtgattcctaaaagatgtatttgattctaagtttccttccctttcctttctcctcctctcctcttctctcctctcctctcctttccttccttttctccttctcttcctgccttttccttttggagttgtttccaaccaagaggcaaaatcccttttcacatccccagcctctgttctgttatctatatttttgccataaaggttagtgcagttccctgaagtcaattctctacatactggtaaaaatccttggggatctttgggaatgagtttttcataagaatgtaaattaatttattaactagaatgctgtggattgccttagaggggctcagcatgggaatggctgcagagttgcaaaaagattctgattccgctctgcctacaaaatcttccccaagaggtcacaggagccagctgacgccactctcctccttagatcctaaaggaattattttccaggatttgcaggcagtcttctaggccagctgaagaagagaagatttatgcaagcagcctgcttggctccagggcccttgttgcattgaggaaaggaaacctgggcagtggtagacaggatcaggagcctaggctccaacccaggaaagcactcctgattttttaggctctcccaaattaacagcatcttttctgacccatctttgtgatgagacagacctgagttcttctaggcaacttggcacacacaataaagtccatctgcctttccatgcacagccctcttgccctttattcgtggtgaggcggacatttggacacaagtgttggccagcctggctagacatgtcctttttttctcagtcagatcagaaggtggtggtgcagcaggagcctcagccttacaggcagaccttctcagctgccgcctcacacaatgtcccagctcggctgcatctctgctccatgagtgggggctgtgtgaactcgggagggcaactgtgaatggcacagcatctgatatgaatttatcaccggctgctggtcgggagggggatcaagctaggggaaggggctgtgtttaatgcaccctgccacaacccaacagtttgccctaaagagccttttaccaatataaaaggacagggtcaaaagtaagttgacccctgacagaatgtacaattattagaagaaggctgtgtgcgagcagctgctggaaccccactgactctgcatcgggcttccaagagtcagattatgaataatcaactcaagattgttttctccacccttctcaacctccccccgcctccctccaatcttctcctcctgttttgggcaagtcctattctatttctacaggaagaagcatagccctccctagcagctgcaataattgtgttcctattgtgatgaagacctcctcctggccacccccctacaagtggccattgtgagtggaaagtcagtgattatacgctccctctgatgctttgggggacccagctgcctaagtgctgacacaggagtgtgcagaaggccagggagggggctggtggaggtggaggcaagaggtgggggaaacccacgtctgtgagactggactctgacataccagaccttttgcataagtcaagccaagaacaaatgaggcattatcaggccccagtgttgagaggtctcatctccctttgaagtggagctgagcgtggggccaagcagcttttcctcctttggaccaagcaaacatccttcttttgatatgctacatgctcattatctctgccccatttaatgatttttgattgaagggtggcggctgggatgccgagaggatcgttagagaggctccatacagccaagcccataagaaaggctttccttgtgcctgggcctaaatttggaatttcttaacagtgtgcgcttgttcttagaggcagataaaggctgagcgtgaaattcttaattaagcaataaatagagagtggggtgtcagcagatgtagccagtagccatggcaacaggaatcacatgggcaagagagctgagactcgatgtaggcctcaggcctgggcctgactgacagctgaagaatcctacaaagcttgtaaaccagattaattagctgactaattatttcatagcgttaatgtaactaaaaaataaaaatagttcaccatgaactgaaacatccttggaaaaaaacagcagggaaagaggcagtgggaaactggctctgtaaggcaaagacatgagcagtcagggcatcaaatcgcatgaagggaaaaatgggcttgctggatttttctcccaactttgcaaatataaaagaacacttgttctacagtcatacccattcccaagcacggcatagaagctacagttgggatacacgataatagttcatcgtattcataattgtttatcacatcaaatattgctcctgcagcatcctaacacaaacaatagtgcacacaaggttcttcacttgtggtctgtttcataagtagctccttgggcaaaattctcagcagctttagaaaggcaacatgaaccaatctccctaacagatctttttaaatgagtgaggttatcttattctgtggctaacaattgcttaagtggcatcacatttcaatcacgggaacaatatatcatatatgtcatattatggtgaatcccatttatctcacaaaaatctagtaaaagaaaatagagggagaccctttcagaaaggttataacatatacactgagctcatgacacatggtattgttaatcttctaaaaagaaagaaaacttctagagaaatagtctatcaggaaaacgttggtgaaataacatggcacattaaccacacttgaatatatttggatgttttgtgccacaattccaagagacaagtaagtattttcttaaccttgctgtgtaaacaaagccactgaggcatggagcaattataatgcaatgccccaggtaaaataaccagccagccactgattaaaaccctaagccccaagcactggccatgagctttccaaaaaaactgcactccgtgaagatgtttgctgagcaaaggcaaaacttgccttggtagaaaagaaaaatgcaagggtcaaaacatattgtatgcgtatgatttttttctttgtcactgggaatccttgagaagggttctcccacaaccctgcctagcacccccgccatcctttctggtcagtgatccacaattatttagtgggcagcacactctagtggagagagccacagccaggagctagaatgcctgggttcaggttttttccactcagctgggttgaagatgagtcaggtatcttaaatcacacatgcagcagccaaacagaggaaatgaagataattgtgatttttctaaaacttcctatcctgggggaagtggtaaaacaatacaaaagatggcccacttagaagtggtcaaccagtgaatgaaaattcagccagttgtcagtgaagcagcactctgaaggaaatgccagccaagaaaaggagccacacccccaaaaaaatctaatatggaattccgtggccatgatagagatcaagcagcttccctacaataaaataaatttctgtatacacacatttcccatgtttttcatcccaggaatatgtccacatagactatgtggtcttgacttacaccatctgcatagattaaatgtattttatgtaaattatcccagtcatggtcctataaagtcaagtggtctgaaaaaaacagttaagtgaaagttacaatctaatcaatatataaaatgcatggcacagaactggaactctacttcttgggctcttgctcgggtaccaacaacagcaactaccattatggcattgggaaatgcagtcaggtatatggaaaacgtggaagcctaatcaccaccttgctaaagatcttataaactttacacagatgatatccaaaattacagctaaatttacacaacccagtatagctacatggcgcactgccatggaggagcagggtgagcctcagttcctgctgagtcctcataccatcactgtgacagcccagaaatgagaacagaagtggctctagccagctatccactccatacactcagaggataaaggaggcaccaatgaccataaaagatcctacggggaatcccttcaagaagcaagagtctccaagtttgttaaacattcaacaaatcctctgtgacttcttattccttttccaactcatattcaaaggaggagatactagggtattccaatacaaataatttttaaaaattaataaaggctatctacctaatagaagtgttttatactaagacattcatttatatcatacatatgcacagatacagatgtacctctacatataagcacacatgcacattcacacagctacttacacagatgtgcatttataccatatgtgtatatataatagtataacttgctattaattcaattaataatgctatcataagggaagaaaatctatagctgcatgatttaattttttttctttgtaccataaatggtttttattacgtttagtttatttgagtattcagattattttgcagttcatgaacagaatatgacctatggacaagacagcctcttcagaagcaggctaagtaatggaaagagagcaattcagattaaaattttgttccagaatacatatcaagtgaatagccataaagttaatggtaactatttactcttatttatggctgtattcggctgaagtggtaaaacaatctcaggaatctctgtccgtctcaagtttttatagttttaggttacatttatgaatggatcaaatcagaaataaaatttgaatggtataattcagtgcaaataaaatatacgacaatccttttggcaaagacataaaaaaagaccaagggagcaccagactctctctctgatgctattaaaatttaacagttctggggctagcctgtaggtccgactcactggacttatggttaggcacaagtgaaagaggcaaagggtggactcaggaccattgcctcgccctctaaatccatggccaccttgggcttgtggcaggggctagaacttgttatgctaataagatcccctggatttgaccaggatctactaagagcaatttataacaaaattgtcactcttgagacctatttagccagattctcctttttactgtaagaagtggcctcacagtgagctgcgattggaacaagcaggtaccatggtgctcagagagaccaatgctgacatggtatagaaaaggaatatgaaataaactccaggaaatcaaaagaagtggatggtcctgacacactggtatcctgagaaacatgcacagtaagaagataaggaaaaacctttggcctctgtgactctgcagtcacagtagggttcctgattacttcaacctcatgttaatcttgacgtaaaacagacacagcccacccctagtgctcatatcagccctccatgctactcatcttcctgacctcagattctcatcagaagttttccttctcaccttctacataaacttccgtcttaattcagcctctctctgcattggtactctctaccttggactctctactgttcctcataccaatggtcataatcagccatccatttttttctctttcttttttttatttttgagatggggtctcaatctcttgcccaggttgaagtgcagtggcatgctcatggctcactgcaggctcaacttcctgggctcaagctatcctcccacctcagcctcccaagtaactgagactacaggcatgcgccaccacacccagctaatttatttaattttttgtagagattaggtctcactctgttgtctaggctgatatcaaactcctggcctcaactgatcctcccaccttagccttccaagtagctgggaccacaggcacatgccaccatgcccagcattttttttttttttttttttttggagagatggggtctcactttgctgccctggctggtctcaaactcctagactaaagcacagccatccatctttacatgtgcagttgttccactacaaacaaatatgacactgccctaagatgaattaaagatattattagtactaactaccaatgtctagtaagcattttttgtgggctaggccttctgctcaagagttttacatgttattctttatttaatttcctatcctttgaggtaggccctatggtcatacttctctatagaggaggaggctgagccttagagaggctctgtgtatgctagctggtgagtgttggagctgggatttaaacccaggcaatcagacttcagggaacattcactcaaccataacacacagctgtccctttcagttcctcagcacttcacagcacaaatgtctggaattgaagggtgattggtgatttctgactatgtgctctcaaaacattcatccaattggatacttacccagataggtgagttgcctcagctggctattgaagaaccagtcacagccttggttctgacctggtgatggaagaaatggaaaagacagacccactcgactcccacatcttaggaggatgtcagggtaaggcggcaaatctgtgtgcaccagcagtaggtaattaccaggagcaaagttgtcaaaggttgctgagtacttgaagtgaaagaaaaacacaatagtgctcatttagtaaggaaccccatcattccacctactccaccacaccaccctgccaaaacaactacagagaacgcagatggagtagtttagaaatcatacaatttagacccagattgtacttttcttgtgggaaatgggaatacttaaatctacttcataaaaaattcataactagagctacaaaatcagactatgaagactgaaagatgccataaggttcatctcgtttaacaatctcaattaccagaggagaaagccaaggcccagacatatgaattgacacgtctcaggtcaaacagctagaagagacaaggccaggtctagaattcctttccagcttttcccacgacttgaagcgacaggcaatgataggcatgtcatccatttatcacagtaatagctaacattgtgggagcatttactatgcaatcagcactattcagtcctcgaaaggcacccctgtcattgttactcttactgtcccatttttacattgaggaaactgaggcaggcagaggttcagtagcttgccccatatcacaaagcagaagagtgcagtgtcaggacataaacctagggtatccacctccagaggcacaccctactgttttcactgcatgaaaattctccagagtgctctcacgggaatctcaaggcaagaaaagagaggcgtacatcctttctgaaagccatggagagaagatcaaaagtgattctgttctgaattcctcatgaccatggcagggcttctgtctccctaagataggctctcaggactgttagcaagaatgtgtatgataagataggaagaaatatatgtgttaaaagtatgaaaataagcttagggaattccactggattgctgtttaaaaatatggaaaaatgtacccactttcctcatggccatttttttttttttagtttttttttttatttcttctgaaaaaaaaaaaaacaggatacaggtgcagaacgtgcaggtttgttacacaggtatacgtgtgccatggtggtttgctgcacctattgacccatcctctaagttccctcccctcacctcctacccccaaacaggccctggtgagtgttgttcccctctccatgtccatgtgttctcaatgttcaactcccacttatgagtgagaacatgcagtgtttggttttctattcctgtgttagtttgctaacgatgatggcttctagcttcatccatgtccctgaaaaggacatgatctcattcctttttatggctgcatagtattccatgatgtgtatgtaccacattttctttatccagtctatcattgatgggcattttccatgtctttgctattgtaaatagtgtggcaataaacatacatgtgcatgtgtctttacagtagaataatttataatcctttgggtacataccctgcaatgggattgctgggtcaaatggtatttctggttctaggtccttgaggaattgccatactgtcttccacaatggttgaactaatttacattcccaccaacagtgtaaaagcgttcctgtttctccacagcctcaccagctttcattgtttcctgactttttaataattgccattctgactggcatgagatggtatctcatagcggttttgatgtgcatttctctgatgatcaatgatgttgagctttttttcatgtttgttggccgcgtaaatgtcttcttttgagaaatgtctgttcatatcctttgcccactttttgatggggttgtttgtctttttcttgtaaatatgtttaagttccttgtaaattctggatattagacttctgtcagatgggtagattgcagaaatattctcccattctgtaggttgcttgttcactctgatgatagtttcttttgctgtgcagaagctctttagtttaattagatcccatttgtcaatttttgcttttgttgcaattgcttttggcattttcgtcatgaagtctttgcctatgcctatgtcctggatggtattgcctaggttttcttctagggtttttatggttttgagtttttcatgtaagtctttaatccatcttgagttaatttttgtataacgtgtaaggaagaggttcagtttcagttttctgcatatggctacccagttttcccagcaccatttactgaataagagatcctttccccattgcttgtttttatgaggtttgtcaacgatctgatggttgtaaatgtgtggtgttatttctgaagtctctgttctgctccatcggtctatatgtctgttttggtaccagtaccatgctgttttggttactgtagacttgcagtatactttgaagtcaggtagtgtgatgcctccagctttgttcttttgcttaggattgtcttggctatacagggtcttcttcgattccatgtgaaatttaaaatgtttttttctaattctgtgaagaatgtcagtggtagtttgatgggaatagcattgaatctataaattactttgggcagtatagccattttcacgacattgattcttcctatccatgagcgtggaatgtctttccatttgtttgtgtcctctcttatttccttgagcagtggtttgtagttctccttgaagaggtccttcgcactgcttgttagctgtatacgtaggtattttattctctttgtagcaattgtgaataggagttcattcatgatttggctctctgcttgcctattgttggtgtaaaggaatgcttgtgatttttgaacattcattttgtatcctgagactttgaagctgaagttgcttatcagttcaagaaattttttgactgagatgatggggttttctaagtataaaatcatgtcatctgcaaagagagacaacttgacttcctctcttcctatttcaatgccctttatttctttctcttgcctgattacccggccagaacttccaatactatgttgaataagactggtgagacagggcatccttgtcttgtgctggttttcaaagggaatgcttctagctttggcccattcaatatgacatttgttgtgggttggtcataaatagctgttattattttgagatatgttccatcaatacctagcttactgagagcttttaacatgaagggatgttgaattttatcaaaggccctttctgcatctattgaaaaaaatcaagtggtttttgtctttggttctgtttatgtgacggattatgtttattgatttgtgtatgttgaaccagccttgcatcccagggatgaagccgacttgataatggtggataagttttttgatgtgttgctggatttggtttgccagtattttattgaggattttcacattgatgttcatcagggatattggcctgaaattttcttttttcattgtgtctcttcccagttttggtatcagaatgatgctggcttcataaaatgagttaaggaggagtccctccttttcaattgtttggaatagtttcagaaggaatggtaccagttcctctttgtacctctggtagaattcagctgtgaatccatctagtcctgggctttttttggttgtaggctattaattaggctattaattactgcctcaatttcaaggcttgttattggtctatttagggattcagcttcttcctggattagtcttggtagggtgtatgcatccaggaatttatccatttctcctagattttctagtttatttgcatagacatgtttatagtattctctgatggtagtttgtatttctgtggggtcagtggtgatatcccttttatcattttttattgtttctatttgactcttttctcttctttgttaatctagctagcggtctatctattttgttaattttttcaaaaaaccagctcctggattcgttgatttttttggagggttttttgtgtctataactccttcaattcttctccgatcttagttatttcttgtcttctgctggcttttggatttgtttgctcttgactctctagctcttttaattgtgatgttagggtatcgatttgagatctttctagctttctgatgtgggcatttagtgctataaatttccctcttaacactactttagctgtgtcccagagattctgatacattttctctttgttctgattggtttcaaagaacttctttctgtcttaatttcattatttacccaggagtcattcaggagcagattgttcaatttccatgaaattttgtggttttgagtgagtttcttaatcctgagttataatttgattgtactgtggtctgagagactgtttgttattatttcagttattttgcatttgctgaggagtgttttacttccaattatgtggtcgattttagattaagtgccatgtggctctgagaagaatgtatattctgttgatttgggatagagagttctgcagacgtctactaggtccactcgatccagagctgagttcaagtcctgcatatccttgttaattttctgtctcattgatctgtctaatactgacagtggggtattaaagtctcccactattattgtgtgggagtctaagtctctttgtaggtctctaagaacttgttttatcaatctgggtgctcctgtattgggggcatgtatatttagatagttagcgtttcttttcttgttgcattgttccctttaccattatgtaatacccttctttgtcttttttgatcattgttggtttaaagtttgttttatcagagactaggattgcaaaccctgtttttttttttttctttccatttgcttggtaagttttcctccatccctttattttgagcctgtgtgtgtctttgcacataagatgggtctcctgaatacagcacactgatgggtgcctgactccttatccaatttgccaatctgtgtcttttaattggggcatttagcccatttacatttaaggttagtattgttatgtgtgaatttgatcctgtcatcttgatataatttagttattttgcacactagtcaatgcagtttctttgtagtgtcattggtctttatattttggtgtgtttttatagtggctggtaccggtttttcctttccatatttagtgcttctttcagctcttgcagggcaggtctggtggtaacgaaatccctcaggatttgcttatctggaaaagattttatttttcttttgcttatgaaacttagtttggctggatatgaaattctgggttgaaaattcttttctttaagaatgttgaatattggcttccaatctccactggcttatagagtttctcctgagaagtctgctgttagtctgatgggcttccctttgtaggtgacctggcctttatctctggctgcctttaacagtttttccttcattttgaccttggacaatctgataattatatgttggtcttctcatggagttggggttggtcttctcatagagtgtcttaatggtgttctctgcatttcctgaatttgcatgttggcctgtcttgctaggttggggaacttctcctgaataatatcctgaagtgtgttttccagcttttttccattctccctgtctccttctggtactccaatcaatcataggttcagtctttttatgaaatcccatatttcttggagaccttgttcattcctttacattcttttttcttgtgtgcatgtcttatttcagtgaggtggtcttcaaactctgatatcctttcttttacttggtcaattcggctgttgatacttgtgtgtgcttcacaaaattctcatgctgtgttttttggctccatcaggtcgtttatattcctctctaaactggatattctagttagcaattcctctaactttttatcaaggttcttagcctctttgcattaggttagagcatgctcctttcactcattgtagttttttattacccatcttctgaagcctacgtctctcaattcatccatttgatcctccatccagttctgtgcccttgatggagaaatgttgtgatcatttggaggagaagaggcactctggcctttttggttttcagcattttctcgttgattctttttcatccttttgagcttgtctagttttggtctttgaggctgttgacccttggataggatttttgtgggggcctttttgttgtttttgttgttgttgatgctgttgttgtcgctttctgcttgtttgtttttctttcgggtccctcttctgttgggctgctgcagtttgctgggggttcacttcaggccctattcatctgatttgctcccatgcctggagatgtcactcaaggagacaggagtgcagcaaagatgggtgtctgttccttctgggacctctgacctcgaggggcaccaacctgatgccagtaggatcgctcctgtatagggtgtctgacaacctctgttggaggatctcacccagtttggtggcatgaggagcaggacccgttcaacaaagcactttgtcccttggtggagagggtgtgtttcactggggggaaacccactcgtctgggctgccgggattcctcagaactatcaggaggacaggccaagtctgctggtccacggagactgcagctacccactccccctggggctcagacccagggagatatgaattctgtcccggagcctctggctggagttattggagatcctgcggggaagccctgcctgcccactgaggaaggatgggtcagagttaggcccaaagaggcactctggctgcagacagccacagctggtatgttgggctgtggggacaagtcttgggacaaagccatccagcctccctggctccaacagggaaaaaacgcagcctagagctatagaaatgggtgctgcctttcccccatccacagagcttagcatgttaggcagttgcaagtcccagtgctggctgctgcctctcctgagctccaaactgggagctcaaatggcttagacagcaggcagctgcagccagtgctggtcgcccctccccgcgggagtttggtaggcttaagcagattccagctgagaggctgtaagaatctgcttagggctctaggcccgggtggtggtgtgggttcgcgagtgggatcttccgacccatgggttgcacaattccgtggaaaaagcagtttccccggctgggtagcggctcactcaccgcctcccttggctgtggggaacggagttccttttccccgtgtggctctcaggtgggccaccgcaccacactgctcttccttctctccgtgggtcacgccagccttctagtcaattttgataagagaacctggataccttggttgccgatgaaggcttcacatgcttattatgtttttgttttgttttttcgatggtagcctccgaacgtctctgtttctagtaagccatcttgccacacggccatttctatcttcactgctcttatttgtctcccttaacccaatccagcctggggactcatacagacttcgattggcaagttaatctttgaccacaaggtggcagtatgcaatgtataaatgctttggtaaggcattttctctggctacaaacacttctctctagggtaaattggctattgaccaataagttttaaagaaatgcaatgctataagatgtgtagaggttgtttctcattgtattaataaatttaaattttcaggcgtaaccattctgcattcacaataacacataaatagattctaaaattttcaagtttaaaaagcaaccaaatctcatatttagcttatattcatctggccaaaatactattgaagttttctttatctgcatcagaatatgccaagactttcaataacgagataacctgctcctctttcaacccattatctcaaacaaagaaagataagaacaaatgagaatgcagcataccaactaatggattccttgggttacctgcagagatctgttgatccaaaggttctcagattgcaatgagtaggtctcttggtccaagagcagagccatccagccacgagggttagacaatgtatcacgtacataattgacagtggttgttttatttctgctgtcagtcatggttaaatcataagaaacttcaggagtattcgctctaaggtgattttaaaaggaaaaaaaatgggttgagagattatttgctcattctgaatccaatacattcctctttcatcaattgcaatcatctttccattctctccacatatgtcttaggccctctttagttgtatgtctagggaggttttagcagtcactgtgtgagtgaaaacaacccagtgggaagttgccattggatcatttgcaaattacaatgtcctggtgaactggaggtggtgactctcaggttttttattttgtttgttttttgtttttctccttgagacggagtttcgctcttgttgcccatgctggagtgcaatgcgcagtctcagctcactgcaacctccaccactaataaatgtcacattaatgattttgtatgaaccaagactatatactatgattttaacaaagaaatgtctatggccagaattttgccttggaccagatttatcaacagcaaaaaacattattattggtaattggatattcacatgaggaacaattgacagaggcctgggacctgacatgcctaggtgctgagactctcagaagtcctgctcaaaatgcccagcaggagtggcttcagcatccttctctagaatgatgaggtaacctgctcctctcctgcagtcttgtgtaatgcctagtactcactgctattacagtacctatgtgttcttggctttgcctttttaaaaacatagattataagatccctaagttagaggtgttttcccctttcttattggtatcctctgccctggcacagggcccagcacacagtggcacccaaatcatgtttgttatatgaatgaacaatgcatagatgagatcttccaaaagcagccagtgacattttctaatgtatataaagttctatatatagaacgtataaaaacgttcagaagaactgcattttaccaaatgaggagactgaggcagggtagagcaaaagcaatatgtgagtatcacaaagtagaactcgaaatttgtgaatccagttacccaacttattctatacagccatcccagaaaatgatttttaagacttcattaaagcataagtagatttagccaatgattagacccctaaaagagagtgaaagtggacctaaagaaataaagcaaaatccaaaaaaaaaaaaaatcaatacacattatgactgttcttcctcctttggtttagttttcatgagaatctttaactgtggcattttgccgcaggcagataattaaattctcaaagtaagggaaatgagtcaaaagaggacattgggttttcacagtgagatggggcatgagtatatctaaagccaatttataagcccgtggaataattcaaaaaggaacttttttaagtgttgcacacttgggcactggaacaaatgggtaacaactgaaatctagattggcactcagtaggtgtgtaaacctgggcaaatttcagcacctatttaacctttagattcatttctttttaaaatggaggcaacaatagaatagatctcatataggtactatgaaacataaagataatctacataaagcactcaccaaggccaataacatctacttaggtctcatttaagaacctcaaatatgccagatttaccattctgcactacttatttgaatgcctagaggtttattcaggatattcggtcatttaaaaacataccaaaaacccttccatggtacagatcattgaccctggcaatgtagcacttgacacatatttcttgcaagattaaatgtatttgtttcatccatgaactaatgaaatgaaagggatgaaaaatgctcagggcatttgggaatgaaagaactattcttttttcagatttccctatgcagcattaactgaacctttagaaatcttgtgaggaggggaaaatgtcttcctttctttgggttttagatacttaggtttgttgtccacccttccccacccaccccttcaggatttaaattggaactaatggacaattctcaacctatattcttagaatcagaatgaacacaaagatcatctgttctaatttccaattcagtgcaggaattcccaccatatttcatccctccccttctttcagttatggggtgtttacatcttcgaatagaaaacattccatatatgggatttagttttaaattgtaatctttagaaaagctttagaatgttaaatttcccttcttagaatttctagccatttgcgctcagtcatcatggctctctcttcccctgatggaaaccatgagtcccataatcccaggatattttccaggaacaatttggcccaactatatttagcaaataaaaataagctttggggacataagtgtaaaacaaacatgataagaggtaagttcgaactaagaaatgtcaaaattggctacagtaggtactgtggtcagtaaataaaacacactagaaatatctaaatttcctcaagtacagggaatgattataagtgtttcaggttccaaaagtatatccttccagtttttactgagacatatgggcttggatttatttaaataaatcttgtgatttatttaaatcacaagacctaaatccaagagagactaattgataaatcagaatttttagttaatgattgaccataagaaataaaagtgcctttcatatagtgggagtttaacaaatattttctgactgaataaacaagtgttatatgcatcagaacactccagctggttatgcagtaacatttctccccaacttggaagtctacctagaaaaatcacatgagggtcaagagatttcctgcaaacttattttcaaaagaaatcagcagttgggtgatcctaagttattagagcttgatacaatcaaccccatatcagtaggatatttgccaagaggacaaacatagtcagtggtcagaaaacctctcctaggcacacacaagcaatgtgcactaataatggtctctggtctaggaaaatgctatgatttccttgaaaactcatatttctgcaatcctagtcaagtgctgtcaattaaaccactttttaaaaatagttttaactacaaaccaaaagaagatctctgttcaaaagcatccatctgttcacatttaattcctcctgcctcacctatcttctcatgcataccacgttgatcattaaaaaaaattacctcggccgggagcggtggcttatgcctgtaatcccagcactttgggacgccgaggcgggtggatcatgagatcaggagatcgagaccatcctggctaacacggtgaaaccccgtctgtactaaaaatacaaaaaattagctgggcgtggcagcatgcgcctgtagtcccagctactcgggaggctgaggcaggagaatggcgtgaacctgggaggcagagcctgtagtgagcagaaatcgcgccactgcactccagcctgggcaacagagcgagattccgtcccaaaaaaaaaaaaaaaaaattacctcaatatgtgatagtataatcaattgggtagatatttccagaaatattttttaattccagcaatgtggtcccaagaattcccctggtcaccttaactggacttaattgctcgtcaaatttcaattaacaccacatttacagaccaatttttaggatgttatttcccctgactcagtttctgtagattacaatttcaattattgaaggaagcatttttcagataatctccccagtttctgaaggcccatacaaatgtggtccctcttcaaatagtgtcaaactgctaaatgctagcaataatttggttctatttgtctttggaaacattgcaccttccttttgaggttcttctccttctagtcagaatccaataatctgatgcaaactccttggccaaccagagacataccatagcacactgtgatcctaaattactttcttatttctccttcatgcactgctcattctctcagagccttgagtctatcaagctcccctcacccatctcaaccaaggtttattagggatgcaatttcataggcactcatgtgcagcaccagctttctgtagtgcaatacaggtagagaaggaggttatcatatatactacacttttatcacagctgataggagagagggtcatatggtaagcattcagatatgctttccactctgaaaagcaactcaaaaagcaaaagacccatctcccatcaggcaagatggcttgtactgaccatcaccaggggccaaaaattcagtcaggtcatctcctgtcctcctaggccaaatgccagaattgaccatggaggggtcttctgaaaagcaccaaaagaacatcaagagtccaaaaaacaccatgaagagaacttaccaacaataattactacaattttcacttgccctaaatagccaccaatttccccatgccctaaatagccaccaatctcccactctttactgttaatgaagcaaaggagcacaaaagtatttctaatttggaggagccaagggagtctgcatgggccattagcagtagagagcttcattactaggggaagaagtctctccctgaacttctcatggctttatgtgcaagaaatcaggaggcaaccagtccattttaaatgttaacccttacctctgcatcagcaacagctcctcctgtctatgatcaaaaagacaaaagggctataagccttacatgttgtttttcttttctgtgggctgtcttaatgtttgttcttttttattttattttttattttattattattattatttgagatggagtttcactcttgttgcccaggctggagcacagtggcatgatctcggctcactgcaacctctgcctctcaggttcaagcaattctcctgcctcagactcctgagtagctgggattacaggcacccaccaccacacccagctaattttttatatttttagtacagatggggtttcaccatgttggccaggctggtctcgaactcctgacctcaggtgatccacccgcctcagcctcccaaagtgctgagattacaggcgtgagccaccatgcctggcccaaacctgtttttaattcagggaaatgttccattagaaatataacactatcacttggtaaaacttcctggtcaaagtaccaatttaccatactagttacttaaagagttatgtaacttagtgcccatgtactgtaaagaactgttgaatcccacaaaggatttgttaggcaatcaataataccaatgagagcagatattaactccctggtttttgtttaccattagcttacttttcctgagggtccatatctgtgtattaaagacaagcattgcacagagctctaaatgctcttgatttggaacagttgtgaaataaatcctctgtaattatccatctcctaagccagacacaccacaatacctaacctcaaattgtgttgcaaacatcttctgagtatttgtgcttgttgatgtcactctcatcttttactgcacaaaggggaagaaaaatcaaaactgtgggcacagccaacaaatttctgtggcatggttttgcatgagcatcctttaaaaatacaccatgctcataacaatccttgtcacagcaccactattctatctgctaacacctgccaccattccgtaatatttcattatcattgtatcattaagtttttccatccacagccttatggattcagaaacacttaaatatttctcctctaaggaagtatctacagtttttgcaacatagttatctgctgttatattaggacaatactttttgcccattctatcttaatatatgaagaaaagcaatagatgtccattatcctactttaggtgaccatataccattgcatctctacttttgatctgctgagtccaattggaatggctatttgagaacacgagaacactgttattgaagctatgcaaccagaaggtagacaggtggacaactgcttgtcagggatattgaaaaatattttatccagcaggtaggaagttagactaagaagcttgtcctcccatatatatgcataccagagctgtgatggggatgactgacactggctggcagaagcccatcattgacccttcttcccaactatatgttcagtgcttttaggttggaagcttaaaataaggcatgtgagagtattttcactatagaattaggcaaatgaaataaaccagagctttttattctggagagctagttgttaaacatttaccagcataccactgcaaccttttattattcataaaacttaataaccatgtaatattgttgatgatattcctcagtttggggtccattgtgatttttagatctttttctactttaattctgtaacctttgctgccaagaaaagataatacatctttgaattttcttgtctcacagggttgttttttaaggactgaaaagataccattagtgatgccatgcctatttatccctaggaaggaaagtcaagcgattattagaggaaaaggtaggccaaaatttccatttgaactcttctttatttttgcattcacagaggcagggggtgactcgtactttgaacactgacaccttaagagtggttacataggtaaaaactgaacgcaagcactacaggagaggatattaagcaagatctaagaatcaaggtgatcaacaagaacactaaccttttattttccaggagaggtgggaaggaagaaacagaaggtactggggcacgatgaatcaaagtcaacgccctgaatgacctgaggttctacaaccacctgggaggttttgctgggtcagtacaacgtcatatgattattacaaattattccctatttttcaggaattggattaagttacattacctaattcccttgccaggcatttgtttctcagaaacaaaaaattctgcagtaacctattcaattagtattatgcctatgcgttgttttgtaaatcacaaatgtaaaatagatattctttaaagagtacctactacatgtcaagcaatgaccctgagggataaataccattatacccattttagtgatgaaagaactgaaacaaaaagcggtaaagtaacttgtgcaaagaaatatacctaggaagtagaggggatatgacttgtacccacaaaggattgttaattacttctctattcttcagtctgaaaaataatttcaaacatgtactgtatatatgtcttgactattttatgtacgtcctgtaaaaactcagaaggactggtcagccaacctacaaaatcttgcaagctcttctaatctccctcacactcaatacagtcaaaaattcgaagacagaatcaaggtctgatctgttgatatctcaatgagtctacgacaagtgaagaagttatacattgctgtaaacaacaatgacaaaaattttcgagaaaataattataagggttgagcttacatcctctctatcacagttttatgtacctattccaccaggacaagaaaacaattacaaataaaggcaaactgatgattgaatgggggtagagaggggttggatagagaaggaatcagcaattagaataaatcctccagtcaaatgattgccccaggaaagtaaaagcccagagaagattatgaaagaagattcttaaatactagatattcctaggaattttagaagactggagatagcattttactcctgggtcttctgaagaaaagccgaatgctgtggactcctcatgaacatgtcctaggagagaaatagacaataaggacactaaaggaagatctgggggcagtccactattttttatttatatttttttactcaacaccaattttgttgagttgctatgtgttaaacagagtttggggcatcataatacaaagaaaatccctatttgccctccttgccatttataaggacagacggacaatttagaaagctatgcaggtgctataagtactgattagagcaagtataaagagctagcacacaacagagatatcaaaacctgcgcagcatgctcagggaagcctagcagagaaaacgacctctatgctgagttcatggaagctgaacattatgaattgaagagcacaaataagttgaatgtggctaagggacagaatgcaggaaaggtagagcagagtgctgagagataatgctggaacccaaagcagacagcaggacacggaagctccatgacacattaggaatgtcagactttccttggaaagcactgagaattctttaaaagtttcacgcaagggaatggatggcaagatcagatctgcatttagaaagttcagagattgaaacaccgaaaaatggcaagctaagtggctgttgtggttctacaggtgaaaagtaatggtagcccagactggagaaggatttggggaaggagagtagtagaaagactcaaaagggatttattaaggaggaaaattgagctgataggtgattagtgtgggaaataaggtacaaagatgagtcaaggatgactccatgtttcaggtttagaccagcatttgcctcagtgggattctgagcacccagagagaaacaggtctacagaaaaaaatcataaatcccattttggcaagttgagttttagagtagccacactaaaaagctcaaaataaacaagttaaattaattttagtaatatatttagcccaatctatccaaaatattatttcaacatgatcaatataaacaaattattgagatattttacattctttttttcatattaagtcttatctatatggtgggtaattcactcttacggcacatcacaatttggactagggagatctaaaaagagcacacaaaatcctactgataatattgtacttgtttcgtgtaattatttctatacagaaaaaaaaaatgtttacctaaagtttgggatagataaatccaagaactatgtgggacattttataattatgggaccctggagaaaaactgtcactggcatgtgtttctgatatgaggtcctgacttacattggcagaactaacactacccctgtctcaccaggaacactgaggttcatagggggaagctggtagaaacagaagctgggaaaggaacgctatccagaatacctgcggcttctacagaaagcatgttttcagagctgatgagagagaaaacaatataagcagcactcacgcagatcaagcatgctgtcattttaacaaaacataaactagactctgccttgtagagtggcagttttttcttcacccaaatattaaatagtgtggccaacttcaaatatttaaatacttctgtcatcccaactgctggctttgagtcataggaaccaataaagtaggaagtgccacaaaggtaagcaccgtcagatttaaggcagtgagggacaggaacagaaggttgccaatgtcaaacaaataacttatagtgaaaatggaccagagagggggcctaccaaggaagaactcacactccaagagcttggttcttagcagaacaggaagaggatgtcttgtttatgcagctatgtaaagcctcactccctgccctctctggacctcttactgagggagggagttaagggttgaaagtgaagacagcagggtgcttatgccatattagatctccatcaacatgcaaccccaaaagatcataactgtgagagctttgtaaatcaactcttagggtgcttgccccagggcaaatagcacaacaaattaatcctttctccatgaaatgcagcaaagtttgcatctatgctgaattcaaattgctcattagctctgacatgttcctaatgaggttataatgctttgggacaaagatcaagccactgagcacaaatagctagggatagaatcatagaaagataaaattagaaggaccttagaggagtgcctctcagactttaataccaatcacctgggcattgtaattcaggacatctggggcccagtctgagagtctgcatttctaaaaaaaatccctggtgctgctgctgctgctggtccatggacaacattttgagcagcaagaccttagagatcatctaattcagttgcctctcctagaggtgagcacatcagggccaagagatttataactggaagcacgctgagacttccaggtgactaattagggtcagttgagtatttgtccatagacctgtgagtcaacctgaaaattttaaatagaatctaaggagtagagtgaccaatcagcctagatgactgaggaagtttccagaacatggaatttgcctttttaaaacaagaaaaaaatccaggaaaaccaggataagtttttcatcctgctagacccttttgaatctacttagaacacagtatcagtattacatttttcttgaccttgtcagtccccaagtggtgggatcatgacctgccaaggcaagtaccttaatatcctgtcccaaagatctcaaagagcaaatgctcaaacaagtttcaggcactacagagccttctaacatcacattgacaagtgcctctccaagagacagcctaccagtagatctcaaagtaaagcatgataaaggactatcaggaacacgcagaaataaatattatagaagcatataatgttccttttaagtacacaaatctattttcctcatttgataaaatgcatgtaagaaataaatcactaatttttataactctcaaaacactcatttaaaacatccttggtaaaaacactaaaataataaaaatcaggctgcatccctgagaatgaagaaaaagtcatgctctgcacaatcaaaatgattagaaataaaaatatatccctacatattattattttactcactggaattgggctcattaacgtcaggtagaataatgaatgtctagaaagcaaaaatgaaaaatttccagactattcagtgctaccagtgcatcgctaaggcttctaaaacagaatgccaaagcactgattccacatgcattcaaaatacagagttagtgcaatcctaaccacaatgattctcactccctgaagtttacttgttcaagtaagaggccaatgaggtctgactgaattacttgacttaatactcatggagttaggacacttaagacaaaggaagaaaataagtgtggctaaatatatacaatgcatttggaataagtaaaagacagaaccctagacattcagcaatcattacctggaaattaaagagggcaggagcaatcctattatgcattataaacagccccgctgctgacttaatggtagtttgagtagcataaccaaggagtccttgctccaatattaataggaaatgtattgtaggaatccaatagttcatgaaattaacaaggaaaatgaactggagtgaagcaaccttgcaagtaataggaggcatcagcaattgcttccctggagcatattgaacacttaaaaagagcttgggaagagtacatgtatataaatgagaatggacatttttagaattttttaataatacttttaatttaaatatatttcaaactctctgttggctgtaagtctttctaagaagaagttattagcccaaaatgtcaatgagaggtcacaagctatgagatctggtccaaagatattgctagttagctgccatttgagtcagcttaaaactaccatacactcatgattcagcagctgtcaaaattattcccatttcacttctttagagctaaatacttcaaataatctagaaaacaatttcccttctataagcctcgacagccagaataacagatgcatgcccatcggcaagctaaaaagtatagttaattccacttacaaaccaatagacatacgatgaaaaagaacacctcctccacaggcactgccatggacaacccgaccaaagcttgaattgaccaaacaagaagctgaaagggtttccatagaagcaagaatgtgacttctgtttttcccagacagagacccatccaagtcttccaaaattgctgcatgaggaaatggaaatgccactaagtttgaagagtttgtaaacttcaactggctggtcttcacagtaaatccacctataaattggaaaacagaaagattattacacaatggcacaaatagcaactaaattcactggagtgatggtcttaggatttaaattgcatatttatctagttttacaattcacctattcatgcaagaaaaaaagtgttttctgtgggtgttttacagtgagtgtttactgtctaccaagctctggtgtgctagagatactaagaggtataactgcagcattggccctaccttcatgcagtctatagtccacattgtagggcagtgatttttctatcatggttgattttaccttccaagagacatggcactattttcaatcatttttggctgtcacaattggggagctggcagtgctactggcagctagtaggtagaaaccagagatgctgctaaatatcctacaatgcacaggacaatccccacaacaaagaattatctcacccaaaatgccaatagtgccaagggtaagaaactctggtctagtgggaaatagaagcagaaaacattaatttattaattactaagcaccaaagatgctatggtttagtcttccaatctttcagctttcattcctctgtggtgagtctaacccctccaatacctcttactataaggtttatttaaacatttactttcaaaagcaaactcaattaatcacttgggcaaatagtattagtaatacactttctaagtattagctgtagggccacacttcttggcagtctttccccaacaccactgccatgtgactcattggtactatcagtccaattgcctaaaaggaaagtatggcagtgatcttctaattcacacacccatgtcattaaaggaagaaaactaagtacacatctcccagtacacatactaccataccataatatattatgtacattataaaatataaaaaaaagaaaataaaatgaaaaagatacaaatagaggctctaatgttttcattctgcagcccaatagagtacatgcagtgaattgattcatacatgaaaggctacacaattgcacctcttgcaacttctgtatttcatttgataccacaaaccacctgcagctctacatttcagtcatactggacttctttgtgatttcccaagcacaacttacttcttggattctattttttgtgtgtatactgttcctagaaattcttccttgcatataccttcttgcaaacttctattcaccttcctaaaccctactcaagaataacctctatgagctcttgcctgacccccttcctcggccccttcactgactttgttgagtcctctattactgcgttcatcatgctctcttacaataataggcttggacatttattttagtgcctagatcaagagttcctggaggacagaaactatgtgttttttatatttgtaccccctaggtccttaagcagagcctgaaatagatggtatttaagcaaatgaaaagaggggttagccaatactattcagtgaaaagggattagagttcataggagtagtgtgattttttttcactgtctcatgaatgatatgaaatagtcaagatattaaagaattgaggaattgcgattgcaagcacttgttatgaggcatttttatttctattattatttctacaatcctaaactcagatgccacccaaataaaaacaatctttcattctgcctacataggaaaaaaaagtaaagtggagacttgttgattattcatttaattaaaaaaacaaacaattatctaaattggtgattcaaaccacaagagcatatttacttaaattacttggtttggctgtttacgatgatcaaatcaactagattactctctacctctttcaccttggcccatgagtcctccaagttatttcttaccacctctgagatgtggttaaaaagtgagcaagaactcctatgtttccctttgtgcatacatcaagccctggactgttgaaaacattaagtacctgaactttggctccttcaggaaaggctgtatgcatgttagtttataccaggtatctacccatctaactccattctttcatttaatcaataaactgcctactaggcatctggctctgtgctagctactaataattaaaactctgagcaagaaatacatgatctctgcctttatgaaggtcagagtccagcagagacataggaccataatgatagaatgtgataggcaccataataggagcaggacagggagctgcagaagctgtactgggagaacctccaggatgtcttttaggagatttaagcaacagtttctactgatgcaatcttataactgaaagagataatgattcacaaagtatttgccactatttataatactgacttgaatatgggccttatttatcatctgttctgtctattcaaataattaccttgtccttgggaacagtctgaacaggttctaatggccacacagttgatgagatcaaaattaacaaaggttgtgttagacaccatcagttcccatcttttaggagttttaatcccagatgacatacacagacttccctgtgatttaaaagaaaaaaagatgaaagcaaaataagaaaactggacacatgaaatacaattcataatgcatgaataaaaacaaagataaaaaagcgagctattgactaagagaaaatatttgccaatcacacatatgacaaaggacctatatccagaatatagaaagaactcttaggtttcaacagcaagaaaatagacaacgcaattcaaaaatcaggaaaaaaaaaccttcaaaagataacccagaaaagaaaatatacagatagcaaataagcacagaaaaaaaaaatgttcaacatcattattcactagggaaatgcaaattaagatcacactaaaatatactatgcacctattgaatgaataaataaaaatacagtgacaatagtaagtgctgatgaggatgagaaagtattaaaactctcctgtttctagtggaatgcaaaatgagacagccactgtggaaaactttggcagtttcttataaagttaaatatgcccttatcatatgacctagcaattcaactcctaggtatttaccttggagaaatgaaaacttacatttatataaaaacctgagacaaatgttcataacagttccatttataatcaccaaatatggaaacaagtcaagtgcacctcaataaatgaatggattaacaaactgcattacatctatctaatggaatactattcgtcgataataaggaatgtaatattgatatgtgcaacaagttagatgaatcccaatggcattcaggagtgaaggaagccagtcccaaaaggttacatactatatgactccatttatatgactgttgaaaaggcaaaactatagtgacagagaatatattagtgattgccagtggtttaaagcaagaggaggctgtggctacaaagatggagcaaggaactggggtggatgcaactgttctgtgtcttgattgtcgtggtggttgttacacaaatgtgtacatgtgttaaagctcatagaactgtacatcaaaaagtcagttttgctgtatattaatatattttaaaaactttaacaaaaagtctgaaaagaaagaaacaataagtgttttcatgattttccacaaaatctctttgacaaacactatccaatcaagctgctagtgcctcactgttccattgttaaaaatagtcttacatttgaggattaccagaatttttgcaatcactcccaacatgaaaaatgatgaaacaataaacaaatagcagaaaagaaactcagtggacacaaagctagtctagaaatcagaagaaaacaaaaactataattaatggccttggagaaataagtatattatatccatgaaacaaatagaagcctaaaatattatttttagaaaaaaaaggaaataggagagtagaaaaaaggaattcaatatcatagaaagtagaacaaaaagacaaagagatggaaaatcagtaagaacattaagatgagaaaaacattccaggaggcccaatatttaaataatcatagctttaaggaaaagaggaaaacataggggaaagaattatcaaagaaataattgaagaatactgtgcagaaggaaaggatataattttccagactgaaaagtcccactcagtatctagcacaatgtttagaaaaagagccacagcaaagtgcatcatattgaaattgcaaaacaccagggacaaggacaagttcctaagagctttcagagagaaaaaaaataagttacgtacaaaaatcctggaatctgagtttttgttttttggtttttttttttgagacagaatctcactctgttgcacagtctgcagtgcagtggcatgatctcggctcactgcaacctctgcttcctgggttgaagtgattctcctacttcagcctcccgagtagctgggactacaggtgcttgccaccacatctggctaatttttgtacttttagtagagacagggttttgccatgttggccaggcaggtctccaacccctgacctcaggtgatctgcacacctcggcctcccaaactgctgggattacaggtgtgagccactgaatctgagtatcttaaaactattcagcctcaagaccagaaggagctacaagatgatggaatattgccttcaaaatttcaatgcaaaatgaacttcaacctggtatcctgtaaccaacaatctactaataaaggggtctccatatatagctcagaactttcaccttccatcgtttccttttttttttttttttttttttttcagaaagttaccttagggtatgttcaaacaaaatgaggaattaagccagaaaagaagaagatgtacgaatcagaaacaagagttccaatactagacagacatgaaggaaatctccaggataatgttcaagggagattctaagatggagctttgaaacccttcttatacattgctggtgtaagcataaactctggattgttgcttggcattatccactaaagttacacgatgatccagcaattttacaacttggcttatattcaacagaaatgcatgcacatgaagaccagaaggcatatagaataatgcttatagcattattatttgtaaataaccaaacttacaaatgatgaaaacaaccaggtacaataagttacatgctttatgattccatttagaccaacttaaaaaacaggagaaattaatctatatcgatagaaggctgaataatgcttgccctttggctagggcgtgcggagtggggttgaatggggggacaagaagaggctttagaggagctgataatgttcatttatttattattagtttttattttttagagacaggatcttgctctggcaatgttctatttcttgttcttagttgtatacatatacatggttggtttgctttgtaaaaatccactgagctattcccctatgatttgtgcacatttctccataaatgttatatttccatgaaacatttaccttaaaaagtaggacaaatactagagaaaggtaacatagaagatgagagggtaaggaaagaagctaaaggagtttaatgtccttgcattacttatgtaaagtttaacagtgctgatgtaatttagactttgttaagacaagcaggcacattaaaaacttaaggccaatagctaaaataatcataacagaatggataactttcaaatgagtaaatataaaaatatgcaacacaagacaaatcaaaatagaaaagaagaaaaaaacagaaaccaaaaacggattgcaaattgaaagtgcaaaataagatggtagaaataaatgcaaatatatgggagacatcagcatgtggaaggtaattgaaaccactagagaaaatgagatttctcccagggagagctagtatattgagaagaaaaggggccctacaacagaatttagggaaacaaaaagatgaaaggtctaaattgaagaagacaaatccacaagtgaaaatgggaaatcacccctagagaaataggaggaagaatgaagcaactccatcagcatctgtctgaatacggtattttttaaagtagcatcatctgctcaaattaattacaataacaacgaagacagccatcctacagatacttcgataagtagggtgaccgtaatttaaattaaaattagacattttttttagtgtgaaagggtatgttaattagacagaatgctgggacaataggtataaacaaactacgcacccaaactaggatatatcgtcatgctatatagcacatgtctttcttgtatatttaagtcattcgtactgaaaattattctattcatctcaatacaaaggtaacattggctgtgagagtaccaacacacgtacaggtatgcttaaaggaaaaaaattccttctgatgataaaaagttcttccagaaagtaatgtttattttaggatgtgactcacagataattgtatgccaccaattatatatgagtggaaagtctaacaatggacaggccaaattctttaaaagtcttaattcctggccaggcgcagtggctcacgcctgtaatcccagcactatgggaggccaaggcgggcggatcacgaggtcaggagattgagaccatcctggctaacatgttgaaactccgtctgtactaaaaacacaaaaaatgagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccaaatattgcgcttttcagaccggcttaagaaacggcgcaccacgagactatatcccacacctggctcagagggtcctacgcccacggaatctcgctgattgctagcacagcagtctgagatcaaacggcaaggcggcaacgaggctgtgggaggggcgcccgccattgcccaggcttgcttaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaggaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtgaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatcaacagaactctccaccccaaatcaacagagtatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactccatggaaactgaacaacctgctcctgaatgactactgggtacataacgaaatgaaggcagaaataaagatgttctttgaaaccaacaagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataacgaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacatagccaaagacaaaaaccacatgattatctcaatagacgcagaaaaagcctttgacaaaattcaacaacccttcatgctaaaaactcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaaaaacagacaaacagagagccaactcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatgggtaggaagaatcaatatcgtgaaaatggccatactgcccaaggtaatttacagattcaatgccatccccttcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaggctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaaggtctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagcaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaattaaaaaaaaaaaaaaaaaaaaaaaaaaaacacaaaaaattagccaggcgtggtggcaggtgcctgtggtcccagctactcaggaggctgaggcaggagaatggcgtgaacccgggaggcggagcttgcagtgagccaagatcgcgccactgcactccagcctgggcgacagagcgagactccgtctcaaaaaaaaaaaaaagaaagtgttaattcctaaaggaatggcaggcacaaaagacagaggctaaaatcagagtcccataaccacagaggtcaggaaccctctttttctttctttttttttttttttttctttttttggaacaactgacacctggcaacatagtggttcccaaataaatctgaaaaatactgtgctaagtaaagattaatagatttttttttgcttgttcactttaatgctagaatttctcagagcctttagtgtattttttcaatgaattttattctgtatatttgagatttacaacatattacagggtacacataggttatagtgaagcaaatcaacatatctattatctcacagttacttttctgtgacaagagcagccaaaatccacttatttaacaaaattccctgacacaatacaattttattatctctaatgcttatgttgtacattacatctctggatttgttggagattttgggaaatagagggtacggtaaacagcacagtataaatataattataaccaaataatcttctctttccagacactatctaagggctagcttttcatgaaaaacacttcagggaacattggtatgaacactaataaatgtcctttgccaaagccattttccatgtgcaattgaagaatatttgaccaggagtgggaggatatcagggtggtcctagctccacaatactaggcatgaaccttaaactgccattcaagtttccaagcctccattttcccctaagttcaagaagttaaccagatcatctcttaggtaatagttggctctttaattatgtggttttatgatttggataactaaccagcatctagacatcccctagaacaaaactgtttaacattttccaccaggggactcttgtcctgcacttacttaagagactgaaaggccctcagctgtactacattcctagtgaattacaccccaagggtgtgattatttttgattatctcatgatagccacccttttgtcataatttacatcttaatttttgtcactttcccattaattatgatgtctatttaacatcaattaagatactgcaacattaatttaccaagacagttactcagtttgctgggaattttgtttttaacatctactctaaggttatttctggaaaagttaaggacctctgatgtaccacagcatcacagaatctaaatctgggtaccatcctctcttgaaaactacacagtctgaaaggaagaatcatctctcaaggtggtaatccttttagagggaaaaaaaaactggcacttatttatctcctgaaaagtatagttcaaaggagattttactaagaaaagttgagagttaaatccaggaaaatgtagctcaataagaaaatgacttttaaaatcttcacatttttatctatagctgtgaaataaataatcttcaatggaagtataagaatcaaaacttatcatttaaatttcaattgaactaagcactcaggaacaaactgaagagaatattcttccttggctcccaataaatctatgatttccataatgatgtgatgactagtatgaatgtagttctaataaaaacaagaacataggggatccattatagacctgaagcctaagagaccaatggcagccaggaacccccacttaggaactagtgcttcccacccgggagtactctttgccccatctgcatccttgtaccctgagaagtcatctagagtctgatttttatcatgtggaaatccatacttaggcacatattagtgaatcacatacaaaataacgaactaggcaaatttctatttcatgatttgacctcttactatgagtaataattctaaattgcaaccaaataaaattctgtcagctacttatgacttctgtgatttatctgtactcataacactaaagcactgtgtatatatgagttctattatcaatatcaccactattacaaataaaaaggtcttttaacttttactaattaaatatgagattcactaaagaatgctattaaaattgcatatcctggatcatcagggggcccagcacatgtaattttgttgtgattgacagcctaaaacaaccacactaaggcacttaccttgtgggcaaaatgaccaagtaataagctgtcagtaactgaagtatttgcatcactttccaagacgtcaattccaaaatctctgcatgaataaactttgaagtttttcaggcgaagattgctacttctaaaaatctataaaatacagcatgttacagcaaaggtctgaggcttggtttttcttgcggacttcctgtagcttttaaaattattgattaagtagaaagaagcatgctatattgtattaaagcaccttttgtccatcaatgtcagtataggcatcctcaagttgctgtgaggtcagcactaatgagtctcctttggtaacacccctttgtacttttcatttctcctcataataaccaatacattaaaaagatcaatatgaattctccacatatctaaaataaacttggagtggccaaatcacacaaaggtaacagagaaaaacattgcatccaagaactctagtgcttaacattttcttcaatgtattatatattaactcatactgtcagaagattgcaaatatgaaataagcagctcagcatgactacagagtcactgtttgtaatttcaacataagttatgtacatatatgtttatgataacccaaacaggggtcatataataacaaaattagcttggtagagttgtaagtctactacttgctatggtttaagcctgtccccgaaaaagcatgttttggaagcttaatccctgatataacagtgttaggaggtgtgtaggttatgaatggattagtgctgattacaaaaaaaacttggggctgtgagttctatcacttgctccttctttgacttctttgcccttctgctatagactgatgcagcaagaaggtcctcagaagatgctggcctctcaatcttggacttccaagcctccagaatcatgagctaataaatttctgtttattataattttcccaaattttattattctgttatagcagcacaaaagggactaagacaccactggtctgggagacagagttgtgcttatgtttacgtctttgaccaattttttgctaattttatttattattaatacataatgactcatttgaagttaatttttgtaagtagcataaattaaggtaggatacaacttaattcttttgtgtgtgaccatctagttatacaagcaccatttgttgaaaagactatatttcccacattgaatggtcttggcatcctttgtcaaaaatcatttgtttatagatatatgggtttatctccagactctcacttctatttcattgacatatatatctatctttgtgcccatataccacactgtcttgattattgttgctttgtagcaagttttaaaatagggaaggataaatcctcttacttcattcttcttttttggtatagttcgagggaagtttacgttttaaatttgctgctattatgttacttaattttccccttattcttcactataaaagtgcaattccaagaatatttttattatttaaactttttgattaatcaaatttgagtgcacaagagttcaagttgtagttctgtatttttttccttcataggtttagcatttctgattgcagaatttcaaaaaatggctttattagcatcttttaatattttcattttactagattatttcctctagaaccaggctactcaagagcagggagacagagtttaagcccctgcaggtataaatcacttctctgcataagagggcactcaacaaatgtttccactagatttgttacccctatagggtatatttatagtgctcatgggaagcattttataaaattaaatgagaacaaaatactaaatacatttcggactccacctgttagctgtcctaattgtatatttttgggctttcttcatccacagttatctttcttttatgggatatatgaaacaaatgtttgactttcttattgtgacattattatatgtttgtattctatttcctgaaggctctacaaacatagttcttcacctatatatcttatgttccagatttctaggcagagacaaagtgtatgtaattttgtctgtattgcatcaaatagtgaccctgaataatttttacatgttgctgttagcagtgagcatgcaaagcttccttataagaaaatcattgggataatgaagagtaaatgattgaacatgaaccttttcttttcctttaagaaaaaaatagaagaaaatttagcttatttcttctaaagtaagagtggtatcttgagctagaatgtttgtgtatcaatgacgaacagtgctttttcttaagactggggcatgtattattcaggatatcgggacatcaaatgcacaacatttggagtctaaattctgcacttggttgtactactaaccaattgtgtgatctttgacaagtcccttcccgttcttagccttaatttctatctctaagtagagatggaaagaaggaatagggaacctctgtgatctcccctgattataaatctttatgattctgttgttctcttctagggttgccaaaaacacccaatggagaaaatgacctaaccctggattagtgactaggaatttgtttaacaactattctacaagcacctatgatccattggtgctttaaaattgtgacagcacagcaatgctcccctcaagggcaagtcaatcccatttaagtagatatgcataatgaattgctgtgagaaaacaagtgacagttttaattttaaaaacaacaacaataacaacaacaacaaaaaagcttacctgggcaccacctgcactttcccaaactgtgaagctctggaacagagtggtgccagtgacattatcccaaggtggctgaaatttagggtatacaaagagaccatacctaaaaagtgaaacagaatgaaattaagccaatttttatgtttctaactttctactttttcttgttgaaaaatacaaagtaaaagtaatgtattagggagaatgaaggtagatggaatctgtgaccctccccctaactgttcttgcctacccctcagccctcccacttttaccctctgtgacctgctcccgaatcccaacaaaatgcagattactccagagcccaagcctagcagcctcccaggggctctgcatatttggaagtttaattgctctctctattgaattatctctggccacaaaaggtacattctgtccttctgccttttcatgtgactctcttctctttaccatcgaactgttatgatctagaaaataatgctaacacaattatatacaaaagccaagacatagaggcagccaagatgtccatcaataggttaatggctggggaaaatgtggtgtatatttgcaatggaatattattcagcctttaaagagaaggaaatcctgccatttgtgacaatacagataaacctgggggacactgtgctgggtgaggtaagccagacacagaagggcaatagtacatcatatcatttaaatgagaaatctaaaatattcaaacttatagaagcagagagtagaatggtggttggcaggggctggaaggaggggaaaatgggaagtattagtcaaagggtacaaagtttcagctatgcaaaatgaataagtcctagagatatacagtatggcaaaatgccaaagtatagaatacagcaaaattaacaatactatattctatacttaaaaatttgctaagaggtcagattttgtgtcaaacgttcttacagtaataataataattcaaataaagaggctctggaggaaaacttttagaggtgatagatatgtttgtgacacagatggtgatgatggttgcaggggtgtatacttatctccaaactcatcaagttgcatacattaaatatggacagctttttgtatgtcaattatacctcaaaaaagcagtttcagaaaatgcacaggaacatcacccaatctccaacaaatgcccaaagtgctctcattgtgagcattctacagtaaaatgtgaaatcataagacagccaaaacatagatgaatttccccaaagttacctggtacaagaatgtgcaatgttctgagtgaaggaaagaagcggagcttgtgatgtttggttggtcatgagatggaaaaagtagccatagccagcaccacacactctgttcccctacagaaattaagaagagttaaaaaatagttaccccatgtatgataaggttgctggaaagaaagactcttgtttgtactcatcccaattttatattcactttctgccaaagtacattaaaactctattatagactcatttattctttttttttccttttgggaacaaaaatagtgatatggtttggatttgtccccctgcccatatctcaggttgaattgtaatccccagtattggaggtagggcctggtgggaggtgactggatcacggggtcagtttctcgtgaatggtttagcactgtccccccttagtactgtcctcaccatagtaagtgagttctcatgagatctggtagtttaaaagtgtacagcaccttgtggctcccaccttgtcttgcctctgttcctgccatgtaagttgcctgctcctgctttgccttctgccgtgagtaaaggctccctgagacctgagacctccccagaaattgatgcttccatgtttcctgtatagcctgcagaaccatgagccaattaaacctcttttctttataagttacccagcctcaggtatttctttatagcaatgcgagaatgaactaataaaaatattgtcattcttcttcctccagccagctcaactagactgcaatttgcccatcttaataactggtatctcatgctcaagcctctttctaagcttccacagtgagtttactcatgacatctaaaattctcctctttggtgaatgcaacagtatatggtagctctccaaggcaaaggtgtaccttgaagtcaagcctacacaatgtgttctctctggctctttgaacaactcaacgatttgtctattggctgaaggccacatgattggaccagtcatgacttagtaccaagacagggtgactgagtacaactacaactcaaatctcttcaaagtgctcttgtcctgaatagactattaagtcgccttgatatttctttataggtcttactatctaaataatttcatgtattttatgtgttcatataaaatctgacttctctctcttggaccatatgagtttggggatctaattctgatcaaactgaacacaatgaggttatctttataaattcaatgaagtacctacaatatgttcatccctatgtaacatagacttaagacaaattaaaaaactgacttcctaaaggtttaagactgtacacagatgtatttttttttggcctacccaatgttcatatttttttggttccaacatgttcaaaccaagagatttaataaaaaattcagactttcagcttttctgagcccaaattcctgtgaagtagccacaggtcaggtgaagataagaagggccttccttcttggactgtggatgatttttccacagtcctcacccttcctggttcactcatttatgatccctgcctagtctctgcagtatttgaatttgcaacctcaactacaggcaacaaagtaaataacatgttggctattctatgaaagtttctatttctgctttcctgaatcacatctgagttctctcagtgtcacacgctcacatcttaaggatcccaagccttctctttatcatcagggagaaagaactctgagaaaaatcggggccctatcaggctgctgcactgcagtgatgctattagtgggaggaacaaagggccaatcgatcaagctatgagactacttcctatgtgcccacgtgcatctgacctctctcagtctgagtggttgtccaaagtcaagatgcccatgtctacctggagaacagaagttaaggaataggctgctcaggtgtaagccctgtgctacatagatgaagggagtctccaaggctcccacatgattcaatcctgatcacctgggggttttccatggcctggctggtgcgagacaaggaatgtctggagtatcctccttggaagtcactcaatcccgggaacacaaactatggggcttggagagctcatcctgaacactggcattagggtcacagtaaagagaatggggagtcataaggaccatgacactgtgccactcaacaagacattaaatgcctttctttaaaaaacaatacttcagtgcagccctctatgcagggctcagtggggactacgctgtgagcatccccttggaacagtttcttaaactttcgtgtgcaacctggtagagttgtcatatttagcaaataaaaacacagaatgcccagtgaaatttaaatttcagataaaaaataaaatattttagtataagtgtgtcgcaaacactatctgaaatttaaatttgaccaaatatgctgtattttatctggcaggctttacctgggggtatattagccaaaggtttttagatattttgatttattaggggggtgatgaggaagggatgagggacagtattctttactcttggccatcacaaggtgctctgataggtctgctgcaggtgatattttgaccccattttgagaactacttctctacaggtgattgagagagtaacgctaagggttactaacgttcctaggagacattcaaagaggagagagacactagaaaaaccacttcctggtgaagttttttgccatgagttgctttgggaacccactgcaaatggaagccactgctgaaaactgaaggaggatagagacctagaaatcagggggagaatccattgccaggtacccagcaaaaatgctgcccagctcagtgcaagttatatttatggtggattttttttttcccttagaagtattttttttttaagtaatgatgagtagaataataacactcatagtgaaaatctacagagaaggcactacagtccaggtactggattttagagtctcatttatttttacaatagttttatgagttttgtattattattacagtttcatagcaaagaaactgaagctcagagatgttgagtaactttcccaaagtcacagagcaaatagttgtcagagccagctccatccaagtccaagtctggaaaagttagagactagagtagagaaatgaaggtaggacccaaaggcaggatgcccaataatagggtgcaagtgaagaaacataaacaagagagtacaaagaaaagtcttgtcacccggtcacggacagaacaggcatttgctgtggcctccccagtagtggagacaacatattgaacaacatcctttgcagaagtcaatgtatcatggacattcacgcaagggaaattccagagagaaattaactgtccaagtaagccagctcctagaggtgtgcatctatagtcaccagaaaaaaaaaaaaagtgaattaatccttaaggcaccggaggtagtgtttgatttctccaaatctggagagcatcttgcaggccagatttaactaaggagttgctcttttcacaccccaaatccagagaatgtaaaatccttctcattctcaccacatggggaaaaaagcatgcacagcttagcgtgcacagagagatacatgggtaggggtgtgggacatttctcaagagtaggaagaagacatgacattttgaagagtacatttaaggaggatgagggttctggaatttcagcattatggagatcaagtgttattaaggctgagacatgttgatgaggactggcttctgacacaggaattttgagcaatgacagatgaaaagactgagattatctgcagttgtcatctactatcagtgcagacagtagggctatggactgaatgcagacaagggttagaatttaatgaggaagttctgacccatccaaggacagggtcttgcactagcctttcacacagctcagggagttttactacattctcagtaaggatggattgagagtgaggactccatacccttttacttgtagctattctccatttctttatccttagactaagtaaactcatttcatcctatggcttcagtcattctagactaatatttttattgactttaatttccaaatgaaaggaaaacttcaggttttggggttttgtttttttgtttgtttgtttgttttcttttttgagatggagtttcactcttgttgcccaggctggagtgcaatggcacgatctcggctcaccgcaacctccacctcccggattcaagcgattctcctgccttagcctcctgagtagctgggattacaggcatgcaccaccatgcctggctaattttgtatttttagtagaaatggggtttctccatgttggtcaagctggtctcaaactcccgacctcaggtgatccgcccaccttggcctcccaaagtgctgggattataggcatgaggcaccgtgcccagccaactttaggtattattaagggtaactctctgaacatggctgatccactggcagtgataatatagcggcacccccaacaggagaagaacttaaagaccctattccttcctgaatgtaccacatgttccacaaggaacacacacacacacacacacacacacacacacacacattcagccaagcaaagacagtatgggggagaaaactgaaaaagattgctcttaacccaataacgcccaattccctgccttgtgtgacagaaagaaccaatgcctcaacccctggaggccttcagttttgggggaagtgtgagtcagggccagagttccccctgaaactagaagcctgaccagcaggcagcagccaggacctggtcagggaggccagcacatactgacacaattgccccgggctgtttatttagctttagcttcaattcactgtgggtcccaaaggttcttaccctgggtatttgtaaatagacagccatttcttcctcatttttcattcggttacaggatgttttgttcctttgtggactaattggccgagtcactcctgcacttcattattttggagtctgagcaattctccaatttcctaaaagcacttagaattctaatcacatgtctcacctaccacagggtgctcaccaaaagtgacttttggatatcactgaatattaagatgaatcactatcaaagatgccaacacgacttcaaagaatcaggtccatttctaagacttcaatggtcttagggtggcctagtctagagtggtggttgtcaatcagggatgactttgttccctacggaacatttaacagcctctggatacattttttattgtaacaacttggaggatgaagaagagagaagagggctactggtattcagtgcatagataccagggatgctgttatacagaggataggctcgacaacaaggaattacccagcccaaaatgtcaatattgacgtagttgagaaaccttggtctatagtctacactagagtcacatattagcaaaataacccacactcattttccagtatcccatctccaaattttgatggaaagacaagcctaaatatgaaaacatggttaattacaataagaatgctttaatagtctttactaggaaactattgatatcatttaaaaccattagatgaggcatcaggcattcccattaaaaaaacatttattagcattaaatcagctatctcaatttttctcttgtgctagaaaacagagtatgcactcctgcttcttggcctcaagaagaatcactgtctattagttggcaaatataagtgcccagtgtatctcttcagcccttgtaaatatacaaagaaataccacagctgttgttctcagtcacgattacacaacacaaactttccccagggaagtgaaactccaccttctctaggtgtgtctctctatatccacgagccttgggaaaggtcagcggtacataagaaccgagggccagagaagggggcttcttaaacacccaccttgtctgcaagtatacaatgagaaatgtggactggaagctaaaagtgatcatctcacttgtccacacagctctatttcattaccaaggaaatgctatttcattaccaagattttatgaggaaagaaaagattcttaaatttaaaaaatatattccaaggactgcatccttattcatcacctttgccagcacagatgctcagaaagcacgtgtttccctgaataaatgggtttgttgaatcatctgccctagtgccattagcatttatggcacatctgggtgatcacatataaacactttccaagcgcatttataggtgggcaggagactgcaactttggtcctctgttagctgataagactcacttttcttacaaaagaagcactttaacagtcagatcgcattccttcctggcccttcttactctcaactccaattgtgtatgctacaaatgattcatgaggaaaaaccacatatttatgcaggcagctggcagcttgcggggaaggtttaaggcaagcagggaattttgtgtggaaatcaattatttgcggaagtcaatgtattatggacattcaagcaagagaaattccagagagaaattaactgcccaagtaagccagctccttgaggtgtacatctatagtcactagaaaaaaagtgagttaacccttcaggcagctcttaaatatgcattacctattgagtggggaaagcttgagaactgaggttgggcctttaaacagaattccttacaaaattgattcacaaaccagaacaaattctcctcaaattaaatgcatgtctccaaagggctcttcttcagagtttttccacggactatcctaaacaggggtctggttataggaaatttccaacacctacataaacatgggagactctgagctctggaagtgaacagtcccttgctgtttgagagcaaagacttcccaaccagagagaatgagaacagattcacacaggttatgtcttctggaaagatgcagcctcttgacagataacaaggagctcctgtcaaagaagtcctagactccggagctggagctgctgagggaagacagcctgagggtgaagcgctctaagaagctacaggtgatacacaaaagaaccaccaccaacttgcttttggaaagcatggcaaacgcctatttaagaaatgtaccagggaatgccacaggcccctggagactcaagcacttatcacccatgggtcctcactggcaagaaggtacaaagctcaggttttgcttctcagtgaaactgccctggactcacctcagctgcaggctgggcagggagagaagcagaccacctgtgaacatcaaaactaaaaaagaatatcatatttgaaatttacttgcatcatgccaggttgaatgtaagtgaactagcaaggtgactgactgcaagcccagctgaattccttatgttgtggctgagagtttggtcccagctctgcatcagggcaatttgagaataatataaaaccacaaaccattgcacagacttaagaatcatttcccctgcctacctaccttccaggtcagagatttcaaggtcagactcaggtatgtgaggagagagagtttaggctttcagagttggttgcccaaacatgaagattaggccatcttcttcaagtctaaataaatacatttgtttaattaatactatcataccaatgtcaatgtcctggccttggtacagctccatgactatggttatcgttatgttatcattggagggagctagatgaagagcacataggaattctcttatttatgcagcttctcgtaagtctgaaattattttaaaattaaaagtttaaaataacaacaaagaaaaatcctaattaatcacaattttctatcacatctctttctgttccacatattatacacatacacacaaatacatgcacatacatacacacacaccttgttattgtggaagcctccttattatccctttggaataaaggtatatttctaaaatatgttcttcaaagtactctgtatatcatccatacaggacacaattaacactaactcagccaagaatggtggctcacacctgtaattccaatcctttgggaagccaaagtggggagatcacttgagaccaagagtttgagactcgcctagggaacacaggtttttttcacgtatacccagttaccacctatgtctttaagtaatggcacatcacagacaatagaatgcaaaaaaagactgaataacagaaagccaatggcacaactgaaaaactggactagactttgcaagatttaatgctgatagcccaacagaatctaaatgcttccactgactaaacttatttttcagtcatcaaaatgattttagaactttggaacttgttctttactttcctttttcttcccccacataatttggttataggtttataccttcattcgttatattaaatacatttttttttgagcaactaccatgttttagaaattgtgctagtgtctaaaggctaatgaaaatagaattagaactttaaggtcaccggaggagccaagatggccgaataggaacagctccggtctacagctcccagtgtgagcgacacagaagacaggcgatttctgcatttccatctgaggtaccgggttcatctcactagggagtgccagacagtgggcgcaggtcagtgggtgcgcccaccgtgcacaagccgaagcagggtgaggcattgcctcactcgggaagctcaaggggtcagggagttccctttcctagtcaaacaaaggggtgatggacggcacctggaaaatcgggtcactcccacccgaatactgcgcttttccgacgggcttaaaaaacggcacaccacaagattatatcccgcacctggctcggagggtcctatgcccacggagtctcgctgattgctagcacagcagtctgagatcaaactgcaagtcggtagccaggctggaggaggggcgcccaccattgcccaggctcgcttaggtaaacaaagcagcccggaagctcgaactgggtggagcccaccacagctcaaggaggcctgcctgcctctgtaggctccacctctgggggcagggcacagacaaacagacaacagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccaacaggggcacactgacacctcacacggcagggtactccaacagacctgcagctgagggtcctgtctgttaaaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgacgagctgagagaagaaggcttcagacgatcaaattactccaagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccatgcgatcaactggaagaaagggtatcagcgatggaagatgaagtgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatagagagaacgccacaaagatattcatcgagaagagcaactccaagacacataattgtcagattcaccaaagttgaaatgaagggaaaaatgttaagggcagccagagagaaaggtcgggttaccctcaaagggaagcccatcagactaacagcggatctcttggcagaaaccctacaagccagaagagtgtgggggccaatattcaacattcttaaagaaaagaattttcaacccagaatttcatatccagccaaacgaagcctcataagtgaaggagaaataaaatcctttacagacaagcaaatgctgagagattttgtcaccaccaggcctgccctaaaagagctcctgaaggaagcactaaacatggaatggaacaaccggtaccagccactgcaaaatcatgccaaaatgtaaagaccattgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaagaccattacataatggtaaacggatcaattcaacaagaagagttaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaattcagctctgcaccaagcgaacctaatagacatctacagaactctccacctcaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatggagacacaaaaaacccttcaaaaaattaatgaatccaggagctggttttttgaaaggatcaacaaaatagatagactgctagcaagactaataaagaaaaaaaagagagaagaatcaaatagacgcaataaaaaatgataaaggggatatcaccaccgatcccacagaaatacaaactaccatcagagaataccacaaacacctctacgcaaataaactagaaaatttagaagaaatggataaattcctgaacacatacactctccagagactaaaccaggaagaagttgaatctctgaatagaccaataacaggatctgaaattgtggcaataatcaatagcttaccaaccaaaaagagtccaggaccaggcagattcacagccgaattctaccagaggtacaaggaggaactggtaccattccttctgaaactattccaatccatagaaaaagagggaatcctccctaactcaatttatgaggccagcatcattctgatacctaagccgggcagagacacaaccaaaaaagagaactttacaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacagaattatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacgaagtcaaattgtccctgtttacagaagacatgattgtatatctggaaagccccattgtctcagcccaaaatctccataacctgataagcaacttcagcaaagtctcaggatacaatatcaatgtacaaaaatcacaagcattcttatacaccaacaacagacaaacagagtgccaaatcatgagtgaactcccattcacaattgcttcaaagagaataaaatacctaggaatccaacttacaagggatgtgaaggacctcttcaaggagaactacaaaccactgctcaaggaaatcaaagaggatacaaacaaatggaagaacattccatgctcatgggtaggaagaatcaatatcgtgaaaatggccatactgcccaaggtaatttacagattcagtgccatccccatcaagctaccaaggactttcttcacagaattggaaaaaaaactactttaaagttcatatggaaccaaaaaaagagcccgcatcgccaagtcaatcctaagccaaaagaacaaagctggaggcatcaccctacctgacttcaaactatactacaaggctacagtaaccaaaacagcatggtactggtaccaaaacagagatgtagatcaatggaacagaacagagccctcagaaataacgctgcatatctacaactatctgatctttgacaaacctgagaaaaacaagcaatggggaaaggattccctatttaataaatggtgctgggaaaattggctagccatatgtagaaagctgaaactggatcacttccttacaccttattcaaaaatcaattcaagatggattaaagacttaaatgatagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaccccatcaaaaagtgggtgaaggacatgaacagacacttctcaaaagaagacatttatggagccaaaaaacacataaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaaatcagtgtggtgattcctcagggatctagaactagaaataccatttgacccagccatcccattactgggtatataaacccaaaggactataaatcatgctgctataaagacacatgcacacgtatgtttattgcggcattagtcacaatagcaaagacttggaaccaacccaaatgtccaacaatgatagactgcatcaagaaaacgtggcacatatataccgtggaatactatgcagccataaaaaatgatgagttcatgtcctttgtagggacatggatgaaattggaaatcatcattctcagtaaactatcgcaagaacaaaaaaccaaacaccgcatattctcactcaaaggtgggaattgaacaatgagatcacatggacacaggaaggggaacatcacactctggggactgttgtggggtggggggagtggggaggaatagcactgggagatatacctagtgctagatgacaagttagtgggtacagcgcaccagcatggcacatgtatacatatgtaactaacatgcacaatgtgctcatgtaccctaaaacttaaagtataataataaaagaaaaaaaaacttaaaaaaaaaaaaaaagaactttaaggtcaccaaggataaatatgtcaggaatatacctaatgaatctacattaccagtttaacctaaaactccattctcaaaacatatgcattgtattttttttctaattttgtaaagcagatacaagagtaagaaagtaaatgaagggaaatggaaagcgttggagggagagcaagcagctagttgcagactcaatttttccattgctgactgggtattattctacaggtcattttgcaaaggctcacaccacccacagcttttcagattaccctctggttctctgcacctgcagccagctcaacccttcttcttgtcagccagtggccagcactccgtccagcagaccacatactacccagtgagacaaggacattccagcttcacacagcagggtgagctgggcaaccctgagggtttactttcctccaggcatttgatgtagtcaacattatgctacccagaaaagtacacaaaaacatggtttcttaagcccaaaagcttacagacatagaaagggcacataggaactcttttatttacgcagcttcttgtaagtctgaaattattttaaaattaaaagtttaaaataacaacaaaaaaatcctaattatcattaggatttttggcctgtagtgaccaacaagttaaatgcagctccagctgtcctggatctgggatctgggttcctacagtccgtgtagttctgcttcctttgcttactggcatattagccactcccattaggcacctaaaatggtgtgtgagtgctgtgcttggaacaaacataattaagaatctaaggaagaagagataaccactacttttactagggtttattcagctgaaggtaattaaaaacagatgatcagtgagaaagaagctcatcctctgagttccttagaaactcagcataatgacatagtggatgctgagaggagtttcctgaaacagtgaggcccttaactcctttgatagaagatccatgggataaaataattagaaaaggggaaatgaaatggcttgccactactctgatgcacttgttcactcaggtctacagctacattgtcccctcaaaaattaatttcttaaatgtttaaacagaaatgtgccaagggaaaccaatgttaagttgtactaaataatgggattttaaaaatcaaggttattgaagtggacttcatcctcctggaatctgacatgaccttatacacctcatgtctcagttttgaacactcttaaaggacaaaatatggccacattaacatagtaagatagtgaaggtttaaaaagaaattggtattggaatcaagtgagacaaaaatcagcacccagagttggtagttcagggagatattttagtttgcattacctagatgaccaggaaacgatcaatatctactttgttttgctccattacctattgcttcaaaaaagtgtttccagaaatcctgagaggaatgcttacatttatcctaaagtacttgtttaatgcaaaattataaattattttcttgatactaatatgcagcaagtaaacatttcataccacaccaccactaacgctgccaccttaaagaacttttggagcaagcttgtccaactggcagcccacaggtcgtatgcagcccaagatggctttgaatgtggccaaacacaaattcatcaactttcttaacacattatgagatttgttttacaattttttttcagctcatcagctgtcattagcgttagtgcattttatgtgtgacccaattcttccaatggcaattattcttccaatgtggcccagggaagccaaaaggttggacacccctgattgagaaagaactttatgccctctcagttctggtcttcctggtagagctgaacatcttacctctataacattggtgggactgcagatatagatgccagatggtgtcaacatttcaggattggagagtccctcggcaccagaaacctggatgatcacgttgtttcttattatatttccatgtcctgaccagtctaatgtttcaacaaatccaggggatccacaaacataattaaaatgtactcaactcaacacccttgattctactaatacacatcagagttcacataatgcatttcatatatatatatatatatatatatatatttagaaaatatttagtatgcacaataaacttaagagacctaacattttgccatcaggcttgtctataaaatatatgacaattttaaatacactgtaatagatttaaaatcaatttacatatttaccatctttccttccatgaattgcctcccaggagatatatctcatctccgtgcatgtccctgagaacaaaagaccccattacttgagtatattttatgtcacttaggaaaacaagagatgctgcaacactacttctttgggtgtgggttgttttgattttgtttttgtgtttttatctgtaaatcagggaaagagatacagatcttatgtactcttcagttctagagtatcaggaatcagaagttcattttaaataaaaagaacagaaaaatagatctgttttacttttgaggaggagtctaagtgactatctccactgttaagtgccacatatcctgtgtcaacaccaaccccattcctagctgttcaaactggccacctgctatctgcatgccctcaccttcccttggaagatctgaaatgtcctgtaggaacaggatggacaacatctaggaccttctcacccaaaccactgaggttggaatagaagagcaagcatgggccatgctaatagagaaattagtcacttaagggctatcaataaagagctgccccaaagaacccttcattacaaagtctttaagtatctaggcttcctcatgccatttcatgggtctgggtttgcatacttgttatgtgtgagattgagtgctttacccaccacacatcaataaacaaaaattttaattccctcacttgtaatacaatagatgtcaaaatcttataattcacaacattcaagcactaaaggctaaattctgcctacaggttttcttccttgcatagttaatatctattccacataattgttttctgctaaggtaatactgttaggatacctttctcaatttctccttgatgtttcaccttttcccttgcacggacaaacataggaacaaacaaagtcaatcctacatctgttagttgacttccctgtggctgtccttttctaatcaaaagatttttctgcacctgatcacctcagttacccttagtttttgtcttttagagctagagtatgttttaaagcaaatgtatctgattcacattttctcactagacagtttccatctcaggatagaacttttatagcttttatctcaacagattgttcttaaatgaaacatgtatttttcccactgatgatactatagaattaaatatcaaacggtatttaacaaatacagttatattctcactttcagtgaaaacctctgatttgcttttttattctgataaaactggagaccctttgtttcttaattcattcatttctttcaactaatagatctacaatgcactagttaatatgctaagtgttcaggagacaatgtcctcaagaaatccggtggtataaagacattaatcagatgaccagaaatgtggtatataattttaaatcaagaagtactgattggcgcttaaagagcttaaacagaaggacttgtctgggagagagaatgttgcaagagaagagtaagtggcatgaacagagccagagagcttgtgcaaagaccctgaggaaggaaaaagtgtggtcttttgaaggaactaaaataaaatattttaatgtcactagagtatggagaaagagaaaaaaaacaagacaagtttacagaagttaacagagacaaaatcactgaagggatcttttaagtctggtgaaaagtttgggattctattttaaaagcaataagaatctcaaaggagagaagtgatatgatgcaatctgagatttttaaggataattctgagttttgcaaggggaatgaactttaggaaacagaagtagatagagttgatcagttgaagattctgaaacatgggcttcttcagcaagccacaggagcttgaattctattaagaagagaattccagatttttaaatccttggccaacatccaagtttgacagtctgtaagactatacaaagacatatgcatgtgacttagaattattgtgaaaattactggtagtaaactttaaaacttcccattatacacttattaacctgaactaacctttaaaagatcagtatcctataggtaaagtttagtaagccaatcagtgatgactacatttaaatttagaatgttttactgtagcccatttctagtgatcataaagccaatatttttataaattaggaattagaaatttggggagaattcattgtgaaaaactgtgtcctacacaagaatgcagaaattcaacaagcttgttttacttaccaactagcagcgcatgacctaaaatattgtagaatacattactgtccaccttcaggcccaaggtcccgcacatgctgaggcctctactgaaggagttcctcactgtgcagccctgtatgaaagactctgaataggaaagagtaaagtaaaaattagatatggctcctgagattctgttgaccatatttagagcaacctacactgtagctaaagacattctcccacacaataatgaaactcaggagataagaagttagaagcagcaatcgaatcaagagaatgagtaactcaaaccaatgggcctcaataataaaaagggtgaaattcaacaatcaagtgttagaaaaaaaaaaacaatctgagaaagacaaagtatgtctaaacaataaaagaactcatggctgtcaagatttccaactggctatcatctttagtatcagctttcatcataatacagcagatgagaagttaaggataacgtgaagagcactgcttatgggccagccttgatctttgaaacctggagcagtgaattaatatttataatttatcaggcaataatattcttggcccaagatagccagagactcattcctaactgtaagcaaggtcaaaggttggcctgaggatcatgactctcacatttgaactggataggtttatacaactaaagaggaagctatcctctactacgctaaaaaattgacaattaggaaaatcattacactggttccataggcatattctatgatccccagatctggttacgaggcctagatgagtcaatgaatacacaattactgagtatcaactatatgtttcaggaattgtgcattgcattgtgctggaaacataaagatgaatgaaactaagtaacctctgcattcatgtatttgcattctgatggaggaaactgacattaaaataataaaaatccattatttgaataattaaactataaatcctaaaaagggagctttgtattattactaggtagtgagaaagatacagatgccaagtgctgggatattagaaaagttactttagtttacagaataatttgacttttacagttgggactatccaaaaaattctaaactttaacatcactatcaacactggatctccacattcccctcaatctcagctctcctactactaggtgccctcacattgctcatcaaggatccaccccaataaattaacccatccatatctacttctgtagcaaacactgcccatagtgcacagaatcttcaccatatcacccaaacagcataggcctgaccatgtgaaaaaccagtaagtacttatgtgtttgtgtagctcttatgggcggaatactgggattagtgaacctttaaaaagtactgtgcaacatttacctatgtaacaaacctgcacatcctgcacatgtaccctagaacttaaaattaaattaaattttttaaaaagtactgttcaaatatcccaatgctttctaactctggtagctgggagtaattagctgcgtaggacatgaggggcttcagggtgttaaacaataaaagattccttaatgagcattccaaaagtttctagcctctgcattttaacagggatttaaaggtaataaatgtattaatgcagtaattttcaaacttttattttttaagcactgaactctttttcaaataaaacctaaaatataaaatatctataaaaatagatgagtgtgcagctactctgattgaaacagaggtgggagagataggttaggtaaaatttgatcaaggaagggctttgattatgttcaattgataacttatttgtgacagctaccctcttttttactgaattggccgcatgtcaaatattctgcagtactatatacagctgaccaaagaaccagagagaaggaaataaagatactaatcaatccgaagcactagcggagaggccatatgcggagccatcctctgaaatgactcaaataaatttaaaaagattggaaaaattagaagaaatagacgtccttagcatgcagataatttgaaatgaaggaaaatgttgcttctggcagttcagaatcctgccctcaatgacctgaaggattactctgcaattacctgttagaatcctagcatctctcaaaagccacctgaaccacaaagtatgccctgatgtcctttgtcaggcatcaacctctgaacccctggggcacagcctctttaaagaaggcaaagcttgaatgtgtgggtgttgaaagtgctgatgaatggggaggattactcagaaatggagctgctgtcctcctgacttggcatctgcacccccattctgtgattctctgcatgtcagcttttggtaatgagtttttgccctggatgttcctacattcaacttttattttagaacttttatcagtgcatttggtcatattctgtttttctgattctgatcttgtttttcacctagttgttctcacctgaatttgatgtttcctgctcccttcttatatcttcatgtctggccaagatctgcacatgtaactgctcctcatttccagaaaaagcacctgggtttcagcccattccccctcatttccccaggcaaaagattcctctgatttaggacaactttacatagaagtgcctggactcccacagtgttgataatgtaatgccaattcacctgtagtcacaaagctagtaagtggtagagacagaattcaaaacacaggattgtgtggttcactcttgtgtgctgtattatagtgatagttctcaaactggactccttggactgcctgttccagaatcaaaaggtttgtatttaaaatacacattcctaagcctaccttagaccagaatttgttggggtaaggtctataactctgaattttaataagctccacaagtgatttgtttaggcatactgaagtttgggaaccatagacctagaatataacaattatccatctctaaatccctcaaatcccacatatcatctatcattccaccatgcatgtagtgccttaaacatgggagaaagaaacatgagaaagtcctaggtccggacccccttacctctcatagctcccaccagagtgagtgagctcagatgcttatggaaggcttgccccaagacttgaaactgcactcccttcaactggacctggctgggctcttctgggaaggactgaacgatcactctggctcccatatccctggatcctagcatcttctcactcatggaatacaaacagtgctgcagattacctgaaatgcaaaataaagtccagagaacctaaagcatgtagaacatgcttccagacaaatctcccagtttgaaaggtactgtcagcaccgaggaaaaaccattactgtttatttcatttaataatcttatttccccttttctttgattctcctctgtatattattaattaaaagatctgataaacaggacatgatgttgccttcattctattttttcaagaaactcccaaatcaatcaccttaattactgtcacaaagagtcagactataacccacaaacccaacctaaatagatgcttatttcaatctaaaagatcctctggaggaaatgtgcaataaaatgaccttcttgtggttgataattgtaggaaagacatgttagcactgaatataataacagcactttttaatcttaagctgtccaatgaggtttccccattactgtgctgttttatggtttggggacttagcaataacgctaccacagaaatgtcaaaggactccagagaagcaactgagcagctcctgcaccaacacctacttccccagctgtgccactaatgaggacagcagcaacctgagcctaacacacacaactacaaatgccagtgaggacagcaaccacctgaactaacacacacaactatgaatgccagggagggcagcaaaccacctggacctaacacacacaactactattgctaccaaaatgttgtgacctcaggatccagggcaccttctgttgatacatggcatttggtggtacaaactaatctggagaataaatcatctctccaatggataataaagatttttcatgttaatgatccaaagaagcaccaataatataaaacactgtatcatatcacagtaaatttcagaatccaatcatttgctattacccagagaagaggtgaatgaagagatatttatatttgtatgccttatcacaatttgattatttgtgccactgatccataagattttcaaatggacaggccttgtgttattaaattcagctaccttgttccacactccagccccacacagaaaagaaatgacttattttgagaatattgtagttgtatttacgatttgtgatgcaatcaaggatgttttccatttggggctaacagatttataatggcttaaacctagaagcatgatctcactggcagcatgatcaaatgcaatatttggcaaaatatgatctcagaataccaaggaagtttgaatagaatgtagatcccaattctgcagaattgataaagttgggcagttgatggaagtgaacccactgttatccaaacattctttttagaatgacacatttgtgagtagatgatttgtagggagggaggtgaggccaaactgcctctctacttctaacaactccccacacccaaccacatggcaacattttactcacatgcacctatatttagacacaactcaaatctttaactccagctccctttgacctttcttccaggctccacacattaccagacatctctacacagttggctggcctgctggcatctcagttatgacatatacaaaattaaactcacgattgccactctcccaccccaaaacctgctcctcttcccatcccagcaaatagcctcatcatccatccagagctcatgcctggaagtcatccttgacacccacgccatcctggaccaaagttgacaaatgatgtcttcacaacatgtgaaagcctcataatctacagcctgggaaaccaaaacatgacctactaaactaaccatccctgaaatagatgcttaataggcacatcaatgtgattcagtgcctgctattctactagaagataaattgaatttttccaccacttacctaaagtatgtggtagttcactcagaaaacaaatcccaaaatggggatgggggagccctacaagtctaatcagtaagaatgtgctgcctgagcccagaactctggcatatggctttcctgagaatcttagaagtggcctggaattttaacattgaacccagaaatgtaattcaactcttcagatttagttctttaatagaaatattttccccagagaaataatattttatttcttttgtcttttgttatctttttcacaaggttgttgggcagtggggcagagaggaggatgaaatgacaatcaagagcattctgaaaactacagaaaagtatgggcatccaaagtttaagggcttattctattttaaaagaggtcaaccacagcaatgccatctatcatcagacagtaagaatattcttttttgctcattagactttccaacaaaacactcttctaccttctggagcattggcctcctggcatgaaacaagcagcttctccctctcattagtgagatttccttgtatggtaatactcctgctgagcagagccacagtggcctttaaaatatggtgctctccagccacccaattctctgtaaagttgtgagaatatctggagaaaaaaagaggatgatagaactgaggacatcactccaaatcttactaggaataataagccactagattaacataattcttcctttggggatctattcatgtttctttagaaactcaataccaaatagtgaactatagacacaagtacatgaaaattagaaactatgctgatcattgccccaaacatttgtgtaagacagaagttctagagacaagacaaactaacttacaaagtctaaatcttcaaaacatttcatgctttttaattttcttgtcaaaatgtctaccattatttaagcagaagaaatatatcattgaaagaccccaatacaaatgtccagaccccaatacagttaagatctcatcttcttccatgtcaacttagccaagctgacactcagtacctcaaaggtgacttaagatagaggtctgtatcctgcacagtttccacagtgacaatctcttccatcggtttggcacctttaacacctgttccactgatgatgacaacttcatccccagggttccagtccacagcatcttctaaagccagcactgtgtctagggcatgggcagttgctctaagacaggtgacaattacttctggtagtgaacctaaagcagcccgaggaaaagttgtccagataatttaatcattaatcaaaacgtgattaatttaatcattaataaatgtgatgttatttagccaaagaatcccataaaataagacctggaaaagcaagcttcaggataggtaagcactaatttttttatattagttttgttttattttgtttgaccttggttttctttttatctataaaaagaagtcaataaaagtaagccagactagagaatagcaacgtgtaaaaagcacaagaattgtggtcagattacacttatatttgaatcacgatcttttcatattctaaccctattctttagggtaataaacttgatgaatgggcttcagtttcctcagttaaaaacagaagtagcagggtcttccatcatagggttttggaaggattcaatgaaatagtatctatgaaacatctagcttggatcttaccacataatagaccctaagggtatgttagtcctttctcttccttttctgtgtcacactgtttgaggatgaaattttaccacctcttttttattccaagaaaaaacaagtggttattagactttctgatgtagacctccataactaatttccaatatgaagacttcacaaataacaaaaatagaggggaaaacaaaaattatctcttagagttgtcataagtcttggtgtattaaatgatcccttcaaactctaaaaactagacctatctaacataggactgctaaatgcagttgaagaaggggaacttgtggttcaagataaactttgtttgtattacactccagcatacccgcctgaccatccccataccagcatgctaatctctaattatcaaagattcaagaaggtcatctgtctcacagtttattctggtcttttccagcaagggtcaaggcacagattttttcaaggcattatctgaatacttcagaaaacacatggcttactccctactccttcctctttctgtagtacatttccttcctcttttgcaatggatgataatttacctttagcccgcagcaagttactgtcctcccttgttgtactaaagtaaagtaataatacttgaatctctaactacagaggtggccgacaataaatcattttcaaattattttaaactttcctctttatttatttgtctctctgtgcataagcacttgtaccaataatgttctaggtttagaaaggtctctgggttaatattgtaatttctgaagtttacttgggcaataattttgtcttaaaaaaatgtacagagttcaaaatttctaattataaggcaggtgaaaattaagacataaatcatcccaaaagaaaataattttaactttatttcttgtttgtatatcttaacccttggaaacaataaaatgaaataaaatttatttatatgtatatgcatatatatgtgaatttttataacccattcttgaatgcctacatagaaaaatctctactaagcacagaaaaatgtttatccaagacaaaatgccgtcagactctgtgatcagtattcacaattctcaattaatatgcaacaaatacctgctatgtgactatcaacatgcaagctacgcatggcagaaccaagagtaaagaccacaaaggtctagctcaactagttactcctataaataatggtcaactctgaatggatgaaaaaattcacagataatctttgaagtacatttttaaactattaacaaaaaagttacatctttgtaaatattgacagagcctctagaaagcagtaaaactagcttataacttatgcactcccattgcaaaaataacacctctatgtgtatggttaaaacatcaagcctggatgtttaatgagtgttggcctcatatttctagctacatagtagatattgacatttagatgagctactaccatcttgaaattattgtaataattatctgagctagaccctcttgcaaacagcttttattcctttaagtattcctccttatgttctttttttaaacaaattttgtgctaagttatttcaattacatcccttctttgtccattaacctgcagtattttcctgcaatactcagtaacaaagtctcaaatttgctgcttgacttcaaagactctccataatgtgaccctactttatggtctctgatttcttaataaattctgttccaagaagcccagtctctttacctcttctcatttaaccggatcgtcctgcctctaatcttttgtcaatttcgtcctttccgctcatgtccttgcttctttctcttcatctatccttttaaagcacaactcaagcccaatcttttcagtgaatttcagaacatacttcatcttcacttcctcctacaaaccttgtagtgatcagtgacatcgttccttcagcaaaatctgtgtgtacatctgggatttaggcattcccaagtatgtctgggtagcttgtgggccatttatttgagctgctttgtgtgggggaggaagtttgcacaaagaaacagatgagagaaaagaagatgacagagaagatatggggtcaatctcagatataggccctctctcttgaccacaaggacctatgactgaacctgagggaataatttggaggaaccctccagatggctttgtcacctgatgctgctccacctgagattctctcaccaactcactctgctgcattctttagaacttaatcctgagagaaggctccaagacttgctgagtaggcaaaccctgtatataatctgtcatatcaccatggctgtctcctttctcacacttaacacaactgcaatttggcctctatttctgtacttagaatttgtctcccccactaaacataacagcaaaaaccatacctatgttcattcaccgtcacaatatcaatgcctttcacagtgtctagcatgtaagtgttccataaatacatcctgaatgcataaaatcacaaatgagacagagaaacaagcaccccaatgtcttggtgtccagttgatcagatgggactctgagtggcatgcagagacagttgccacatttcatcatgggacacagtacactcccacatcttggggttttaaatgaaagcccacaccctcaaacccatgtgttcagtactctcatggcaggtaccagcagtagatgcagggatgaggcagcccctactaccttcctaaatggagaacaatgaccaagaagccaaagtaggaggaaaagaacatgaaagatgcctcatggtgactaaggcagacagatgaactcacagaaaacacattgtgagaacacgtagaacaagcaagcagaactgctaaaaaggggagaaggttttgtgagagttgggggcctcagacagtaaaatttttatcactattgaaatatccacaggctgagcaggctcagggaagcctggggagacttcaattacataaacaatagtcagtcccatgtatctcagcactaaatcatcctgaaattactaaagtgcatgtgtcttttctctccaccttacaggtggcaccatgactgctgtgccactgcctcatgtctcctttatatatggcacaattcctaacacagcactggacgcataattaacattcaattcatagtggtttaaatgacctattttaagtattgccttctgggcaatcacttgtaaactcccatcagatatatacccaagtgagtatataatattcaatatgcaaaaagcagaaaaaaatacaaacatttattgaaaacttagaataaccccaacctatgcaaactagtttcattgtcaagtaagaaatctttggttttttatttttgttatttattttaacagattgtacagataggaaactatgattcttcaaggacaagattatatggtaatagatatcagcacaaagttctgaaactagttcttctgaatctaagaccagagaactagacaagtaaatggaatttgtagcctctggaaatagctgtaaattaactgtacccaattagctttgatgttcaaaaaattatactcattacttcataaatgttatttaaatgtcatacaaggtggaccaactgacttctctgatgaagaaggcattgcacacattttacatctgagtcatttctgttcatagaactattgaaacccaggttgggtagctcccttcctttctgtaccacaaatcaaaaacacataaaactacgcataaaaagctcaataatttatgaatatgctaaatgaaaaaggactatgcttttaacttgtaatttaatactatgtttaatcactttgggctttccatgttgacctgttaaccaacaaactactcatttactcccactaatgacttctactcataattgtatttcctacaaattattgttcaagcatttcaatgtcattcatccataattacacagtctcagagcaccattcttactaaatgggcatggagaaaaataaaataatccttgtgggttaacacactaaaatcactaattgtcctctgtttgcttactttgtaggacttaaatctttattctaagaataactgccaaggcctttcaaaatcatttagggtgggggagggagagagggagagagggagaggtgggggggagagagagagagagagagagaaaggagaaagaaaaggataatttattaaaataatgtttgcatcagaataaaggaacttacaaaaaaaactagaaatattgtcctcaaatatatacaaattatttcccccttatttctggatgcaacatcaccattatccatagcaaaacattagatgctgtcttgtatgtggatgaacatttgtcacgcactaggaagacaaacacaaagaacagagtccctttcctccagggcccatgatcagtacaagaaatagacaaaaatcagaagtgcactgtgcaaggtgcagtgacactcaggggtgtacagacatggagcactgcaatcacaccaagggagtggtcctttccaggaatgcttcccagaagaggtgataactgagctgggtcttgaaggacaaaccaaagtgtgccagatgacaaaatgggaagcgtaccctaggcaacgacaatgatgtgtaagatggtgggggacattcgaataactgctacatatgtggcatggccagagtacaggtatacagaaggtataggcacctagtgactgtcccttcattctgaagaggtgagcaggacccatccaaaaatgactcacaggccctcccatagcacttagagtttatcctaaaaattatttggaaaccactaaatgaatatttgggatgaaatctaagaaatgatactgttgtgaaactgttttaagcccatagtacacatatcaaactaagagaagaaaatccttagtgagaaaatggacttactgtatgttggggaaaatgagtcaaatcctaagacaaacaagagccagccagtagggaaactgagagcctgatgtgttactctatgaactagatatcagacctttggagcaaatgaagaggactgggcaaaataatgcaggactttgttgacctgttttaaagaccttaagttgtatttgaaatagttataaaaacaaatatatacatatatatattcattatttatttttatatatttatttttaagttctgggatacatgcgcagaacgtgcaggtttgttacataggtatacacgtgccatggtggtttgctgcacccatcaacccatcatctacattaggtatttctcctaatgctctctttccccttgccccccacccactaacaggccctggtgtgtgatgttgccctccctgtgtccatgtgttgtcattgttcaactcctgcttatgagtgagaacatgtgtttgattttctgtcttgtgttagtttgctgagaatgatggtttccagcttcatccatgtccctgcaaaggacatgaactcatccttttttatggctgcatagtattccacagtatagatgtgccgcattttctttatccagtctatcattgatgggcatttgggttggttccaagtctttgctattgtgaacagtgattcaataaacatacgtgtgcatgtgtctttatggttgaatgatttataatcctttgggtatatacccagtaatgggattgctgggtcaaatggtatttctggttcctgatccttgaggaatcaccacactatcttccagtgtaaaagtgtttctatttctacacatccactccagcatctgttatttcctgactttttaatgatcaccattctcactggtgtgagatggtatattgaccagtaatgatgagcttttattcatatgtttgttgatcgcataaatatcttcctttgagaagtgtctattcatatccttcgcccactttttgatggggttgttttttcttgtaaatttgtctaagttccttgtagactctggaaattagccctttgtcagatggatagattgcaaatattttctcccattctgtaggttgcctgttcactctcatgatagtttcttttgctatacagaagctctttagtttaattagatcccatttgtcaattttggcttctgttgccattgcttttgatgttttagtcatgaagtccttgcccatgcctacgtcctgaatggtattgcctaggtttttttctagggtttttatggttttaggtctaacatttaagactttaatcaaacttgaattaatttttgtataaggtgtaaggaagggatccaatttcagctttctacatatggctagccagttttcccagcaccatttattaaatagggaatcctttccccattgcttgtttctgtcaggtttgtcaaagatcagatggttgtagatgtgtggtattatttctgagggctctgttctgttccattggtctatatctctgttttggtacaagtaccatgctgttttggttactgttgccttgtaatatcgtttgaagtcaggtagcatgatgcctccagctttgttcttttggcttaggattgtcttggaaatgcaggctcttttttggttccacgtgaactttaaagaagttttttccaattctgtgaagaaagtccttggtagcttgatggggatggcattgaatctataacttaccttgggcagtatggccattttcacgatattgattcttcctatccatgagcatggaatgttcttccatttgtttgtgtcctctttgatttccttgagcagtggggtttgtagttctccttgaagaggtccttcacatcccttgtaagttggattcctaggtattttattctctttgaagcaattgtgaatgggagttcactcatgatttggttctttgtctgttattggtgtataagaatgcttgtgattttgcacactgattttgtatcctgagattttgctgaagttgcttatcagcttaaggagattctgggctgagaggattgggttttctaaatatacaatcatgtaatttgcaaacagggacaatttgacttcctcttttcctaattgaataccctttatttctttatcctgcctgatggcccaggccagaacttccaacactatgttgaataggcgtggtgagagagggcatccctgtcttgtgccagttttcaaagggaatgcttctggtttctgcccattcagtatgatattggctgtgggtttgtcatagatagctcttatgagtttgacatacatcccgtcaatacctagtttattcagagtttttagatgaagggctgttgaattttgtcgaaggccttttctgcatctattgagataatcatgtggtttttgtctttggttcggtttatatgctggattacatttattgatttgcgtatattgaaccagccttgcatcccaggtatgaagcccacttgatcttggtggataagctttttgatgtgctgctggatttggtttgccagtattttattgaggatttttgcatcaatgtttatcagggatattggtctaaaattctcttttttggttgtgtctctgccaggctttggtatcagaatgatgctggataaaatgagttagggaggattccctctttttctattgattggaatagtttcagaaggaatggtatcagctgctctttgtacctctggtagaattcggctgtgaatccgtctggtcctggactttttttggttggtaagctattaattattgcctcaatttcagatcctgttattggtctattcagggattcaacttcttcctggtttagtcttgggagggtgtatgtgtccaggaatttatccatttcttctatattttccattttatttgtgtagaggtgtttatagtattctctgatggttgtttatatttctgtgggataggtggtggtatcccctttatcattttttattgtgtctatttgattcttctctcttttcttctctattagtcttgctagtggtctatcaattttgttaatcttttcaaaaaaccagctcctggattcattgattttttgaagggttttttgtgtctctatctccttcagttttcctctgatcttagtgatttcttgccttctgctagcttttgaatgtgtttgctgttgcttctctagttcttttaattgtgatgttagagtatcgattttaggtctttcctgctttctcttgtgggcaattagtgcgataaattataatttagtgctataaagatctgttgttagtctgatgggcttccctttgtgggtaaccagacctttctctctggctgcccttaacattttttccttcatttcaactttggtgaatctgacaattatgtgtcttggggttgctcttctcaaggagtatctttgtggcattctctgtatttcctgaatttgaatgttggcctgccttgctaggttggggaaattctcctggataatatcctgaagagtgttttccaacttggttcccttctccccgtcactttcaggtacaccaatcagacgtagatttggtcttttcacatagtcccatatttcttggaggctttgttcatttcttttaactcttttttctctaaacttctcttctcacttcatatcattcgtttcatcttcaatcactgataccctttcttccacttgattaaatcggctactgaagcttgtgcatgcatcacatagttctcatgccatggttttcagctccatcaggtcatctaaggtcttctctatgctgtttattctagttagccattcatctaatcttttttcaaggtttgtagcttctttgtgagggattcgaacatcctcctttagcttggagaggtttgttattaccgatcttctgaagcctacttctgtcaactcatcaaagtcattctccatccagctttgttctattgctggcaaggagctgcgatcttttggaggagaagaggcactctgatttttagaattttcagcttttctgctctggtttctccccatctttgtggttttatctacctttggtctttgatgatggtgaccaacagatggggttttggtgtggatgtcttttttgttgatgttgatgctgttcctttctgttagttttccttctatcagtcaggaccctcagctgcaggtctattggagtttgctggaggtccactccagaccctgtttgcctgggtatcaccagcagaggctgaagaacagcaaatattgcagaacagcaaatgttgctgcctgatccttcttctggaagcttcatctcagaggggcacccagctgtatgaggtgtcagccagcccctactgggaggtgtctcccatttaggctactcagggtcagggacccacttgagtctgtccattctcagatttcaaactctgtgctgggagaaccactactctcttcaaagctgtcagacagggacatttaagtctgcagaagtttctgctgccttttgttcagctatgccctgccccgagaggtagagtctacagaggcaggcaggcctagctgagctgcggtgggctccactcagttcgagtttcctggccactttgtttacctactcaagcctcagcaatggcggatgcccctccccaagcctcgctgcctccttgcgtttgatctcagacagctgtgctagcagtgagcaaggatccatgggcatgggaccctccgagccaggcacgggatataatctcctggtgtgccattttctaagaccattggaaaagtgcagcactagggtgggagtgtcccgattttccaggtaccatctgtcatggcttcccttggctaggaaagggaattccacaaccccctgcacttccctggtgaggcaatgccccaccctgcttcggctcacactccatgggctgcatccactgtccaacaagtcccattgagatgaacccagtacctcagttggaaatgcagaaatcacccatcttctgcgttgctcatgctgggagctatagactggagttgttcctattcagccatcttggaacccaaccccgttttgccaaatttttaaggtaacgttcatgggttccaaggattaggacatggacatacatgggtgtcattttttagcctatggttgaataaatagtgctgtgaaaattggctattcatttgaaaaaaaatagataactgacaaactatatcagaatcaattctagactgattaaaataagggcctggtaactttttctgtaaaaagaacagggagataataaagagtttggggtttgcagaccacgtggtctctgtcataatgactgaactttgcccttatagtgcaaagcagccatagataatacctacacaaatgggtgtggctgtgcctcaataaaattttgtgtataaaagcaaggaatggaccagatttggtccatggctcatagtttgctgaccctagttaaagacagacacaaatgtgaaaaaaaagaaaaaaaaaaaacaataaaagtaccaaaaaacaagtaggtaaatttttatatagtctttgtacagaaaagagttgataaacataaaatcaaaggcagaaaccataagagaaaatatttgtagatttgccatcacaaagattggaaaactccatagaagtactaaaagataaataacgtgtgaaagaaaccggttctttgtacctctatcaagaattttacaaagagagctataagccagaaagccccaattgggatctcaaaataagctgaaaaagttaaaattgaggagactgtttcagaaagaagtatattctgcctttctgccacaagtaaataccagctatgtgtacacaaaatagaagcgaggccatgtgtgtcttaagtccaatgaagaaaatggaatgagttttagttacatccccttgcaggccccagtttcatcatctctaaaatgaaagtaacgatcccagtctttcaggcttcacagggtggttgtgagagttaaatgagagtaaagaatgggaagcagctttgaaaattataaagtgccaggatctaggtaaaatccaattttgacaaataccaaatataatacccaattcaatgatactctttttccatgaccaggctgaaagcaatactattaatagtattgctttgatgatgcatatggaagaattctctttgaaggaaaaatcacaagcttctgcctatgtagctttccatttacttaacaaagttgagtttcttgtggtactcaaaaatgtaaaaaatgaaaatctacaccacattaaccatttagtaacctaaaagaagactactactgaagcatgagggtggccaagggggagagttgaaaaacaggacagaaggtgttagcaggaagctaaatagcacctaatagccatgctataaatttcggactttaccttagaaacaacggaaagccactgaagagttttgagcagcagcacaatataaacagatttgtgtttttaaaagatcaacttggctccagggcaaagaatgaattggaaagaacagaagtggcaactagaaagtaagtttaaaagcttacacaataatccaggcataagttgaaggtaccataaactaaggtgacagtaatggagatagagagaaggatatgggctcacaagttatctaagaattaaaatcaacaagacttagtgatggacatgataagaggaatgataaaggaggtatcaagaatgacaaccaggtttctagctgagagattattggaaaacggtaaacaccatcccatctttagactaataatgggacaacttcaccaaatcaaaagtgtaaacaaataataacaatgataataactgacatttattgagtacttgctcaacatctgccattgtggtaagtacattacatgttttgtttcatttaaaccacataacaaatatcatgagaaatgtcttaaaataatgtccgttttatagatgtgggaactgaaacactggggagttttttaaggtccactagctagttcacggtagagatgggatttggaccacgcagtccacttcaagagcccaggctcctcatacttactcagaggaagatgagtgagtgagtactctatgacggagcaaagtcaagctcatctagagaagatgcagaacgccagcaaagatcctcacaacctagcaggaaaatggaaactacagaaagtttgaaaggaagagatgaaccttggagctagttactttcctttgagaagctttgtgtcaagatgagaggcttgaaatcctcgtgtgtctaaaatacgatacagagtcagttatgaggtttgctttggtgactgtgatggttaattttgcgcatcaacttgactgggctatggggtacccacaactttagctaaatgtaaattgttcttcgtgtgtgtgtgtgtgtatgtgtgtgtgtgtgtgtgtgtgtgtaggtatttctaacgtaattaacatctgaatcagtagactaagtaaagaagattgccttccttaatgtagatgagccttatccaatcagctgaaggcctgaatagaacaaaaaggctgagtatgaagtaacttgaactgagacattggtcttatctggtcttcaaacttagactgaagcataggttcttcttggatatccagcttgctggccttctgactggaacttacaccattggtcttcctggttcttacgcctttggacttggactctctatctgcttctctttttctctccctccttctctctcccttcctctctctctttttatctctctctctctttttatctctctctctctctcaaatggcttatgactcaaatggggcgaaagttaatcctgaggcttttgctcaagtttttcattcacttattcaagcaaatattttttaaagcatattatgagtccaggcactgttctaggcaatgcagattaaaaaaaaaaaaaaagtaaagtgcttgccctcatgatgtatatattcttctgggagaggtaataaaataaatacaaaaaaatgtgaaaagtaaaccttacataatacattaaataatgttgaaagctaaggagaagaaaaccgaaggagcaatgtcaaacggtgatggggaaatgttgaaatttgctcagaagttaaacagccattgggaaagaggcattccctttcatctggagtcacaggactgccatttctgcctccatgagggcagagtttgactgaaaatgaagccagctgaggggaaagcagaaccaagagtcgcagagaaacaaaatcttaatgacttcattggagcacctggactcagctgtgcctcaagttttttcttttcgcctcaagttttttattttcagttatatgaggcaataagtgctcttattttttgttcgaattgggttttctgtcacttgaaaccaaaaaaagacctgactaatgccgacactttcaagtatatatagaaacttgaagtaccttacaatgtgtttctaagtggggttcctgctgtacttggattattgaatagctagaactcatttctaattagcagtatacatttacatgcaaacacctgaaattaaaagaccttaaaaacagcatgttcacttaaatgtgtttaaacaagtcccctaaagtgtggtttatactattaatttaaggaaccctttcttaaagattgttccaaggttactcttgtccagatcaatgagattttagcagacacatatctgccactgtaaatagaatggttatacagtgtttagacttttttgaagtattgttagacagaacagaaaaaaaaccttattttttgttggtggtgttggttatattttagaggacatagagccaagggtcagtctccatctgctcaaaagagagaaacactcatcagtcactggctgtcctaccacgctagggttccaagtatgccaggaccatgcttgctgatgttaactcaactgtgtaattacgatctgccacaacatgccagctgaccagaaccccaacactgaattaaagctcatttaaatttaagagtagaaaaaggaataaatacttttttaattttcctcatcctcctttctccattcttcccctctatttaatcctccttccttcccagtcctaaataaaaaccaacaaaacaaagccaaataacaaccgcaaaatgacagtggctctccccttcaaccccacatccctctagggcaccctttttacatacatagcaggttgttgggtgggacttctgctcctctagaacctaccaggaggacacatgcataggatcaggagatgataagcaccccacattatagggaagccacagacagggagaaaacatctccttggggcttattaaagaaagctaatctaactctgccacttttgccatccctggagcagagtccactccatcatttatgaatgaccaaaaacaaggagattcaaagaaatcctgagagatggggatgagccatcagcctgggtgagctaaccctggcctttcctccccttcctatagagcgaggtgtgaaactacttctctcttattaagcaaagaaagagggctgcataagtatcaatcacagagtgacctgtaagaaggggagactggcttcttttcccaggtggaatgtctgcatatgcagcctatttgctcagctgctcatgcttatctaagcaggggaaacaattagagaaagagcagagcagagaaaggggtgataagtgaaacatctttcatgtggatttgtaagtttcctctggatagctgaattgtagggaagatagcttggcttgaaccaactttctagtactccaccaagaccaacccccaaggtggatgctaacggattgaaaacccaagtggggcttccacattgagaaactgtgcagtggaaaagcctcctacaagactccagtgatttcatgcaggcatcttaggagggagactcaatagtcagcaattattattcagagagagagcaacacccaacagaggatataggtgcaccgttaagtattaagcttgttaaacctctcaccttacctcttccacctgccccatactgacaatatgaaataagaaggattagaggaagagtgagggagcagaccctaccatcccaagtgcctcaagttgaagctttgtgggtgaggaaggtaacattaaatgaataggagactgagtttttaaactagattaatcaggactggcattttcaatatctgaaatcaactggaaagctattggtaaccaaggtgtttttaaaggacaagaaaaaggatccatcagaatacagacgaaggtagtgactaaagaaaaataaaatctattctgagtcagacttctgtctgaaaggtttgcatctaccaaacatccctaaaattgtgtcggttgcatttgctcaggcctgtggcaaatttacacaccacatcagctcaagtttcccatgaaatcacaggtaatattttgtggtgataaatgcaaggggaaagcagaagtgaaaatgtggcttgagcttggacagtcagagtgcactttccccctgggcaccatgtatagtccttagtctgctaagtaactctagcggactttgggaggcctcccctggttattttttgaaaagaatacagtgttcctttctttggtagtagaaaatcaaagtccacatgaaatcaggaagtcccaataaccatagagaaggcagcaataaggagtaggagagagtgaagtcaatacatgcagagacagccagggtaagggactgaggggtgagtcctgtggacattcggacccttgaagacagtcacgtctaaggccattgtctttctctccatcctgcgttttgattacaagaattcataaatccttggttctaagtttgtttccagtgggcttctgtcccctaaaaccaaacaatttcagagtaataaagctacatataaaaatgccatgtcatagctctggtttgtatctagctcaagggaacgagagacagaagaaaagggaggagtcttggtctagaagaaataggtaaggaaaggggcaagaggagacagcattggagactattaatcaggtgacgagagagtggagatttaaaaatatattgttggataagaggaactgttatgacatgaaaatgggctctagaaagtttcaccctacatcaaagaacagactttatagaaaatgtcccagagctaaatcagtcttggggaaacaggaatcatgcagagaggccctggacacctcaaaaggatccatacaccacagctaaaagaatgacctagtagagttttttaatcacagttttaacagtggaactctttcttctaacaaactgttactttgaacacaaatatataacagataaaagcaataaatcaattacttgagcaatttaaacctttattacttgacctccaatattcattgtttagggaacccctaaatcccctccaggaaacatttggattttgtggagcacaatgtgaaaaccactgaccggaaacacactcccacacatgtgcctgttccacacactttataccatgcttaaagacagcctgatactctagcaactatgaaaatagtgcatattacacagtactcatagcaaccatggaatttacatgcagacacttggcattttcagaaggaaaacaaaccatatctaagcttgcttatttagaccactgcttttatttattcctaccaaattcttatgttccttgcaattgcactcgtgctttcttcaatcatgccccacatactgctttttctcaggaatttccatgtatatttaatgcctatatcttgtaatttcttgaaaaggacaaagacagaagtccagccaaggccatgagactgtttttctcctaagaaactgtcagccaaatttctcagggagaaactggaaatgaagtgagagacattgataaatttccctgctgaacaatcaataaaagctccaccatcctgctcagattcccactgtggaagcaagagccgtaattacgttgtcaaaaatttaagttgcccaggctgacagcaacccacttgaaaagtgacaagtgattggcactcagtttggagtggtgaacctggattggcagacagagtgatgaaagcaaaaggcaagagtgaaatttccttattgactacagctacccaaaccccagactgccactcaggaggaatcctgagaccctttagtcatattaacgcatcaaagtgagcagctgacagaagttactaaacaatctgaactccaccagcaactcagaacctgtcctcatctactctcaaacagaaacagaaaagatggtgctgtgtgtgggtgtatatgtgcagctgtgtgtatatgtgagtgtataagggtgtgggacttttcctacattcaaagaaatacatgtaacgtgctttcaactccatcttgccttgtgacagctgaacaccaaagcctgtttgcttagcgattttaatccaaggtaaaaatcagctggagcagaagggtttcaaagagcaataataaagaatgagatggaaggagaaggtgggaaagtgatcggactgacatgcagaccatttgtgtgattctacatgacctgagctggagttaaattagaatccattcagcattgctgctgaatattaggaaccaaatgtctgccaagggcctcattcgctgggcagtgccctgcttcagactatactgggacccatgcaaatagtttctaagaagccttttgtaaccacgcccaggaatggtggttatccacagctgggaagcagctgcaccaagagagattaaaatctaaaggtgttgactgggtggtgggaagagaagagaagatgcctgggaatgttgttaccacatgatctccaaggttaaaacccttctgttactctgatgaaaagagatagacaagaaaattaatatgtgttttgtgtgcccaacactctggaacacttcatgagcaataagtttatgaagtgggaactgtgtttttctgattttttagagatctgttgaaggtcatagctgatctgtggcagaactgggcccatttctgattccaatttgattaaccacttgaaccagtgtttctctgagtatagtcaataggccacctgagtcacatcacatgtacatttccaggcccagaaatctagatttacaaaaacctctcccaaaaggctcttctgtgcgccaaagttggtgaatctcctcattatgttatcctgggaaactgagtgaatgctgggtcattagggacttcctgggtgcaaaacagtgaatcaagttgctcactattttgcatacttgatggtgaaagaaaattagctttttcctaaagccccagtgtcaccagacccacctctggccccggcaaaaggccagtgaaattatgaaatgactttagccatgatataccaccacgctggaggggaaatctgtctgagacctcaggtggtgagggagaagtgacaggagagaattgatgagctgcacgtggggctgcgattctctgacagatacatcaggaaaggaatccctgtcacccaaatggctgagctcttttctacataatatttgtttcaaatgcatgagatgctgcagcatcacatcagagaggaaatggcttgatctttgcctgtgttcaatgggcaagctctgtgattcaggtgagatcctagtcaattctctgtcctaaatgctttggggaatgtttaaccagttttgaaaatggcctaatctgggaatataggaaaagggggagagagagagaggagggagaaggagaataaaggagagggagggaggagaggaagggaggaaaaaggggagagagagagaggagggagaaggagaataaagaagaaagagggagaagaggaagggaggaagcatggagagagaggagggagaaggagaataaaggagagggagagaggagaaagaggaaggaggagatggaaatgaggaaagcagagggagaggaggtctcattctcaatatccagtaacatcagatggctgaagtagcaacattttttctgaactttcagaattttcaaaccatattagaggcatatactttgcttgaattgccccatattgactgtaagcaatgggactagggattttcttgacatttgcttaaccacaaaggcttacatgcacaacgtacatttaaaatacaggcacaaaaggtatatttatgagttctttctttgattcttcacaatagagcatgataattagatgagcttggaatgaaagaggcagaagaaaataattaggagagttttcatttttcctcatttgaattcctattttcaggaagagctgtgctatctgcatcatacaggacagtggctctcaaatctgaggattcctcctaagcctggggtcctctggacgatctatgggctggctgaaccacaaatatacaccaacttattccccagatgcacttttttactggtaaaaagcaacatattgggttagtggcttaagaggccattgagctagagcaaacatttgaaaaccatggctgacgtgggaatagatcctgggctacaaaatcaatgtagttgcttgctgatgaagataggaggtaaaaaggtccccttggaagttgatcatagaatcaacatagcaagcattttgaatttctatccagtgagttatggggtatttttaacctcacaaaatttgatccccagtgtctagcacactgggtagcccacagtcaacacttaaatgcttgaggaaaagatcttgcttcctttcatagtaagccaaaagagacacaagcatgttttttgatagacaatgattggggcctgtggtcggtatgagacagagtctggataaagaaaaatggcagattcctcagcacagctccatgccctcatctagagcaattatcctatgacaagtggattattttgtgatgccaatatagaaatatcattgtgtaactgacattatgatttctggagattgagtcactatctggagcccacattttttatctgcctttggctcatgctatgcaaccaaaagcatataaacacccactgaaatatgcttactcattattttatactgatattttacagttgatactaaggattatcctggcacacctggtaatttcctgactctcaagagggaaaaaaaatgtccattttgcaaagtggaattagatgatcagaaagcaaataaagttggagtagaacacactgtagcctaatctattttctcctgggaatccttaaacaccccacctatctgtaagaggattctaagtagaactgtaattaaaccctgctcatggggtagagggtttggggagacaggaagaggttcaacaactaaatgaggttgtctgtatttgatttgggataccaggctactgcatgttgagagacatcagtacatgctaagtaattgtatcagtcagttttcactaggctatgctgcaattacaaatgcaaatttcagtggcttatgacaaaggcttatttctcactcacatacatgagagcagtaggtcagctgcagcactgccccatgtcgtcttcgttcaggttctaagcagaaggaactgcctctatctgggacaggctattctcaagtggcaggaagaaaacgaaatggctaaagcatcgtaacaggtcttaaaaccttcacttggccatgcagtcccccagttctgctcacattccactgaccaaagcgagtataaggctaagtctgctcttgcaaaggggccgggaagtatggtccacccacaaggaggcactgaaagtcacctaacagtgggtggaagtatacacaatcctcttacagaaagaggagcaaacaattgggaacggtagtgtactctgccacatgaatcgtaacagttttacttgttatttaaggaaatagtgccatgctctaactgacctggttggctcagcaactatagtcaaggacttttaaacagttttatcagtttccactgctagacacagctctacttcatttcctctgatcaattgcctcactcaccgtgcagagaaagagttccattcctcacagccaggaacttgactccatagggaaagaagggagttgagtaggaactcccgtagagtgtgatctgagctctgccttggaagggcttgtcttcggatccaatccggagctctccaccatcagaaacaaggatggcgtgtgccctgagctcgatgggtcctggggccatgaaaatcagcttgccccctaatggacaaagggaaaattgtcagtccctgggaggataaggcttaccgttttgtcagtttcaatgcctgatgaaatccccttcatttaaatacttctgctggaatgtagacttattttatcatgctctctcttgtagaagcacagtagggtagaccagacattcaggagtggaagcactattatttagccagtttaggttagctattactattctctgctgctttattacattttcatgacaataatctaaatgtccagcaatttaggaatggttaaataatgtatgagaagaccactaactttaccatttaacaatagataaaattaagaaaaaaaaaaactgggacatatacaagaaatagggctagaagaagatgtgccaaaattgtaagaattatagtaaaaggaaatgtaactagggctaacactgtggcatttgtagcattttagctgaccagcatccattatactttcttttgttaacagaccctaatttccttgaggtattgctctgccccattgactagagctgagtggaactgtcaagcaagacatcttatcctaccatggccagagtcacatactcgggctttaagagaaatatggagcaaaagggaaaagaggtaggaaatatttagatctcagttccagtggtggcattctaaggagcctgggaagaacacctgcttctgagatgcccacctgcccatctccctgcctgccccaccacccgccacttgcatcaaatgctttgattcctacgtatttctgtccctgatttttcagactgctttccactgattagtaggttacccaataccttcccaatacattccatttttaaaagaaaagttgggttctcttattggcaaccagataaccttaactgatacatataccattttgctctgatgtccaaattttcagtaacacaagaatattcgtttataatagaattattttgcattgtgagattaaataatttaaaaattaaaaagatattttcatttttataatatctttctttaaaaggctttagaatgtttatattttacgtagaattttctcaataatgtcaaaataattaaagcatcccatatgaataaacactttaacttcaataagctatttagtccatctttctcctgcaagtggtttacaaaaataccagactagacccttccatcctgtaacaaagtagtcagaattgtatctttatatcagacacaccagaggtcctcttttctaaatccaacaatagtttcccatctcactcagaatagaagtcaaagtccttacattgggctacaaaaggtccctcatgatttgctacccaacctccaatacctctctaatatcattttctaaagctcacctgttcacacatatgctacaaacatattggcctgcctgttagttctcaaacaggcctcagggcataagctcttccctctggaaggttcttttgatattcccgtgaatatcatgaataagaattatcaaaaatatcggaaatatctaaaatgttattggaattatcggaatgttctgatattcccatggctcactctcccttgttactattcaaatgttaacttctcaccaaggccttccctctccagtctatataaaatagcacaccctagccccttgcctaaatgcctttttctttgtaatacttgatatcaggcatattatatatttacaggtttattttctgccctctccccaccagaatacatgcttcctgaggggaattatctgttttgttcacttctaaattattggtgtctagaaaagtggctggtaggtagttggcactcaacacacaattaatggttgagtgaatgaatgaatggacatatctttttggagattctgatttaagtgcctctatttccttatatacaaacacacacacactctcccattttctcagaaaggatgttgttcttacacttaatttataagcctacatagtgtctcaatgagcaaaggggggcaaaggatatagagatagcaaagtatcagaaatgcctcaaaaggcagattctactataataagaagagtcttggtgagatgtagtggagggcaaagactcttcatctgctaatgtagtcataaatccagagtgccaagttattgagttgagtttttgttgctttccagaaatcacagctggaagtagttaaacatgcactggagaaatgagagggagagaggaaaaaggcaaaaatgactttagtcattatcatgtaaaccaaaaataaaattttaagtcccccaaaccaactgaattgacccctcctcttaggcaagggcgttacaaagttaaactgtaaaactagttcaggccatgacggggagtgtcagagatgcctcattataccctcctccctttggaattcagaaataagtaaccagcattaacattaaaacagagacattaagactgacaaaatagactctgtagcaataagacaccaaattccaacctgactctagtacagcaccacatgacagatagccggccctgaaagaaactgaagtattttaccccaaaatatattaaacggccctgcaaagctgtctcttgtggggaaaatctacattctgtagaaaattcccttccttttctggatctttaccctgagctaggagagtgctaactaagagtctggaacctttttagatctgctaagaaacatttacagtctattctctctgaagcctgctacctggaggcttcatctgcataataagaaccttggactccacaaccacttatcttaacccagacactcccttctgttgattccaggtctttagataagttaataagttaactctttcaaccaattgccagtcagaaaatctttgaatccatctatgacctggaagcccccactcctacttgtctaacctttccagaccaaaccaatgtacatcttatatgtattgattgatgtcttacctctccctaaaacatataaaaccaagctgtagcctgaccatcttgggcacatgtacttacgacctcttaagactgtgccccaggccatggtcactgaaatttggctcagaattaatctcttcaagtattttacagagtttgactcttttcatttaattgtttacctccgtcttagtgcagagacagtgatcaataaatgtttgactcaatagtcaaatatggaggccacttcttccctaacttctcttcagctttcctcagctcctttcctcaagactcttttcttcaattctaaagcccaagccatatgccatcagtaatagtcacgggatgtatacttggaccagaccccttcaaggaccttttctttcagtcacaatttagaatgacacaccccgcataggtatccagtttctccatctgtaaaatgggcatggtaagaatttcaccctcagaagattaaggtgagatttattgaaatagttcttatagatccctggtctggagtctgacacctattcaacccttaatgcaatggtctctgtggctatcatcacactcaccatcttcgcttcctccattattgctgtgaaaccatccttgcaaagattctgacagtgagaaaaatctaacatggcttactccatcttgttcctagcctcacaggctggctggctttgctcattcctaggtgtaagccaagctaactatgggaggaatttagtttatagtctaaccttaaacaaggatgataatagcccttcccaaaattaaactacctttgtaaaactaatgaaaggccacaaggctaggattataagaggtgccaaaattctaagatgtttagcatatttaaatgattactagccattgttcaagaggtcacaagatttgcaactcttccaaatactccaatagataacatcactattttagaaactgtcaggcctctgagcccaagctaagccatcatatcccctgtgacctgcacgtatacatccagatggcctgaagtaactgaagaatcacaaaagaagtgatatttaaatggcctgttcctgccttaactgatgacattccaccacaaaagaagtgaaaatggctggtccttgcctaactgatgacattacctggtgaaattccttctcctggctcatcctggctcaaaaagctcccccactgagcacgctgtgaccccccactcctgcccgccagagaacaacccccctttttcctttacctccccaaatcttataagatggccccactactatctcccttcactgactctcttttcggactcagcccacctgcacccaggtgaaataaacagccttgttgctcatacaaaacctgtttggtggtctcttcacacagacgcaagtgaaattttgctgccatgactcagatcagggaacctcccttgggagatcaatcccctgtcctcctgctctttgttccgtgagaaagatccacctatgacttctggtcctcagaccaaggaacatctcaccaattttaaatccggtaagcagcctctttttactctcttctccaacctctctcactatccctcaacctctttctcctttcaatcttggtgccacacttcaatctctctcttctcttaatttcagttcctttccttttctggtgatgcagaagatgcgttttatccatggacccaaaactctggcgccagtcacggactcaggaagacagtcttcccttggtgtttaatcatgcggggatgtctgcctgattattcacccacatttcagaggtgtctgaccacgtggggatgcctgccttggtccttcacccttagcagcaagtactgcttttctggggggcaaggacccccctgaccccttctctccatgtctctaccccttctccacttttctggggggcaagaacccccccaaccccttctccttcacccttagtggcaagtaccgcttttctggggggcaagaacgcccagaccccttctctccgtgtctctaccccttctccgcttttctagggggcaagaacccgctgaccccttctctccgtgtctctactctctcttttctcttggctcgcctccttcactatgggcagccttccaccctccattcctccttctcccttatcctgtgttctcaagaacttaaaacctcttcaactcacacctgacctaaacctaaatgccttattttcttctgcaatgccacttgaccccattacaaacttgacagtggttccaaatagccagaaaacagcattttcgatttttccatcctacaagatctagataattcttatcgtaaaatagacaaaccgtctgagatgcctgacgtccagacattcttttacacattgtttcctccctagtctctgttcccaatgcgactcatcccaaatcctccttctttccctccctcctgttctctcagtcccaaccccaagcatcactgagtctttctaatcttccttttctacagacccatctgacttctcccctcctccccaggctgctccttgccaggcccagccaggtcccaattcttcctcagcctctgctcccccaccctataatccttttatcacctccctcatcacaccaggtctggcttacagtttaattcctcgactatccctcccccacctgcccagcaatttcctcttaaaaaggtggctggagctaaaggcatagtcaaggttaatgctcctttttctttatctgacctctcccaaaatcagttagcatttaggctctttttcatcaaatatgaaaaacccagcccagttcatggttcgttcagcagcaaccctgagatgctttacagccctagaccctaaaaggtcaaaaggccgtcttattctcaatatacattttattacccaatccgctcctgacattaaataaaactacaaaaattaaattccggccctcaaaccccacaacaggacttaattaaccttgccttcaaggtgtactataatagagtagaggcagccaagtagcaatgtatttctgagttgcaattccttgcctccactgtgagacaaaccccagccatatctccagcacacaagaactccaaatgcctgaaccgcagctgtcaggggttcctccagaacctcctcccccaggagcttactacaagtgctggaaatctggccactgggccaaggaatgcccacagcccgggattcctcctaagccatgccccatctgtgtgggaccccactgaaaatcggactgttcaactcacctggaagccacttccagagcccctggaactctggcccaaggctctctgactgactccttcccagatcttcttggataagcagctgaagactgatactgcccgattgcctcggaagcctacaggaccatcgcagacgctctgggtaactctcacagtggaaggtaagtccgtccccttcttagtcaatacggaggctacccactccacattaccttcttttcaaggacctgtttcccttgcctccataactgttgtgggtattgacggccaggcttctaaacctcttaaaactccccaactctggtgccatcttagacaacattcttttatgcactcctttttagttatccccacctgcccagttcccttattaggccgagacattttaattgaattatctgcttccctcactgttcctagattacagccacacctcactgctgccctttaccccagttcaaagcctccttcgcatcctcctcttgtatccccccccaccttaacccacaaatataagacacctctactccctccttggcgactgatcatgcaccctttaccatcccattaaaacctaatcacccttaccccactcaatgccaatatcccatcccacagcacgctttaaaaggattaaagcctgttatcactcacctgttacagcatggccttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccagcccagcatggccttttaaagcctataaactctctttacaattccaccattttacctgtcctaaaaccagacaaggcttacaggttagttcaggatctgtgccttatcaaccaaattgttttgcctatccaccccgtggtgccaaacccatatactctcctatcctcaatacctccctccacaacccattattctgttctggatctcaaacatgctttctttactattcctttgcacccttcatcccagcctctcttcgctttcacttggactgaccctgacacccatcaggctcagcaaattacctgggctgtactgccgcaagccttcacagacagcccccattacttcagtcaagcccaaatttcttcctcatctgttacctatcatggcgtaattctcataaaacgtgttttccctgccgatcgtgtcctactgatctctcaaaccccaccaccttctacaaaacaactcctttccttcctaggcatggttggatactttcgactttagacacctagttttgccatcctaacaaagccattatataagctcacaaaaggaaacctagctgaccccatagatcctaaatcctttccccactcctctttccattccttgaagacagctttagagactgccccaaccttagctctccctgactcatcccaacccttttcattacccacagctgaagtgcagggctgtgcagtcagaattcttacccaagaactgggactgtgccctgtagcctttttatccaaacaacttgaccttacagttttgcctagccctcaagtctgcgtgcagcagccgctgccgccctaatacttttagaggcccttaaaaccataaactatgcttaactcactctctatagttctcataacttccaaaacctattttcttcctcacacctgacacatatactttctgctccctggctccttcagctgtactcactttttgttgagtctcccgcaattaccactgttcctggcccggacttcaatccggcctcccacattattcctgataccacacctgacccccatgacttatctctctgatccacctgacattcacccccatttctccatatttccttctttcctgttcctcaccctgatcacacttggtttattgatggcagttccaccaagcctaattaccacacaccagcaaaggcaggctatgctatagtacaagccactagcccgcctcttagaacctctcatttactttccatcgtggaaatccatcctcaaggaaataacttctcagtgttccatctgctattctactactcctcagggattattcaggccccctcccctccctacacatcaagctcggggatttgcccctgcccaggactggcaaattggctttactcaacatgccccaagtcaggaaactaaaatacctcttggtctaggtagacactttcactggataggtagaggcctttcccacagggtctaagaaggccaccacggtcatttcttcccttctgtcagacataattcctcagtttgggcttcccacctctatacagtcttataatggactggcctttattagtcaaatcacccaagcagtttctcaggctcttcgtattcagtgaactaatagtcttttaaaaacacacctcaccaagctcagccaccaacttaaaaaggactggacaatacttttaccacttgcccttctcagaattcaggcctgaactcggaatgctacaaggtacagcccatttgagctcctgtataagacgctcctttttattaggccccagtctcattccagacaccagaccaacttggactgcatcccttccaccaaaaaaaaaaaaaactcatcatccctactatcttctgtctagtcatactcctattcaccgttctcaactactcataaatgccctgctcttgtttacactgccggtttacactgtttctccaagccatcacagctgatatctcctggtgctatccccaaaccaccattcttaactccctcttaaagtaaataaataatctttgctggcagggctatgctgaacctccttaagcactctctagttagatgtcctggatcctcccaattcttaatcctttaatacctgcttttctccttgtcttattccattcttttttcaattcatacaaaaccatatccaggccatcaccaatcattctatatgacaaatatttcttctaacaaccccacaatatcaccccttaccacaaaaccttccttcagcttaatctctcccactgtaggtttccatgccgcccctaatcccgctcgaagcagccctgagaaacatcgcccattatctctccataccacccccaaaaattttcaccatcccaacacttcaatactgttatgttttatttttcttattaatataagaagacaggaatgtcaggcctctgagcccaagctaagccatcatatcccctgtgacctgcacgtatacatccagatggcctgaagtaactgaagaatcacaaaagaagtgatatttaaatggcctgttcctgccttaactgatgacattccaccacaaaagaagtgaaatggccagtccttgcctaactgatgacattaccttgtgaaattccttctcctggctcatcctggctcaaaaagctcccccactgagcactttgtgacccccactcctacacgccagagaacaacccccctttttcctttacctccccaaatcttataaaacggccccgccccatctcccttcactgactctcttttcggactcagcccacctgcacccaggtgaaataaacagccttgttgctcacacaaagcctgtttggtggtctcttcgcatggatgcgagtgaaaaacactaagattggtcttttgagatttttttttaggcttttgtatttctgaccaccagctgacttcactcagattcatgacccaagactcaaccagtgctgtggcccttacctaaagacagactcagtacacaaggactgttttccatacccctatgatttcatccccaacaaatcaatattccccataccctagttccctgcccaacaaactacccttgaaaacccctaacctctgagcctccagggagattgatttgggtaataaccccatcccccaaatggtgtggagggccttgcatcagttaaatgctttctttactgcaacgccatggtcttgacgaattgattttgtctgtgcaactggcaggaagaacccaccgggtgattatatctacaacctgctcaatttctacaagtgccctaccacttgagcactgctagaccatctgcatccaacatctctctgttactggtccttttgaaatattttgtcatatataatatttcatactctagggtaaagcagcaaggtcagtctacaggctccatgccagagcagtaccacactgcttaccagacttccaaaggattccctaacaattttgacttttttcctttcattgtcattacatagaaatgcagtaataatcatgagtcccagtgtgagcaagaaggaagaaatatgacctgggctacagatcaaattttatgttaactaaaatttttccctcacagccacatgtcattaacatcctaaataattatattcaactggtagaacatggatttgtatgacaggactgccgcattgtaaatagtcaggaaatctaaactgaccttgatgagcaagtggtaaaggcagggaacaaaatcaaggttcctgtcctgagtctgctattgacctctgaatgagcctcagtaagtcccatacaattgctgggcctcagattactcaggtcccaaatctctcctactcagtgcctattaatggtctgtggtttcatccgcaaagtggaaggtggaattatgagttcctttcaactctagaacacttgacgtctacatctttatgaatgcagtcagatgtgcatgggacactaatggaggcacaaggctcatgttttcctgacactgcctgtgctgcagtaatcactgaattttttcttaagcaagatatgagatgcatagtcaggaattcatataagactacagggaaaacaagaaagctaacatttattcagcacctaccatgtaccaaaatctgtagatatattgtctaaaatgaccttcaaaaccagtctgtgagatcaagatcacattctttatttcacagagcagaatgtggctaagaggcattcatacctattccagcccagaatacacagaaccaaactagaacccaggactacccaaccaaaaggctcagatcctatccatttgcacaaaccttccccagtagctctcaattcactagggttgttctcatagttacatttaaggaaaaacatgtgtgaacctaagaaagtttgcctatggcttgtttatacatgatttattttaattttgttaatgaagatataccttgtctttttccaaaaaggatttgaaacagattacaaggattagtgggtaaatatataaacatgggctttgtcccttttaccatgaagcaaaatgttaaatacactgaaacaaattggtagaaattttgaaacatcatttactgacaggaactaataatgatgctaatgaagggagaaaaactcatcccaaagaaaatgaattatctgcgttgtcaggagtgtcataaacaggactaattaattaatatgaacatcattaactcctgctaaaaagcatccccaccccgctttattagtggcaaatataagaaaatctaggtacatttagaagaaagtttgatgaggaattcagctatttttgcctgaaataattagataaacaaatgaaaccttctttatgtgaaagaagataaagtttatacttaatctatctttatgccaaggcaccaagattttcatcctcacactttattagtttaaaataaatatacagtgggctgctttaaaggatagttacttgagtatgggagggctgtgggaggactttattccatactttatagagcttgaccccatttctaaatgctgaaataaagagcagggctgaaatcagcctttggctgtgacccttaaattgcttgttatgactttcatgaaagctgactatgtcccacaagtaaccttgggtaattttataaaaatcaatcaaccatcattattgttacttccctctaaaataaataaatgaacacaactttttatatgtaatcacctctttccattaaacatctcttttgtttcttttaaagggaagtaaaagagacttttagcagctagctaatgtttgcaaagtacatcaaaatctgcttttggctaacccaacaattagtcatcctctataataaccacaaaataatttgttgttttttttaagaaaacaaatacacaattctattttcccccttacagaaaaaatttaagtataaatattataccatacaatactagtcttcaaaagagtggctatacctactatcttcaactctttttcatgactgtcttttgaaccctccctggtcaggcctttacctgatgaacctgcaaaactgctcctctcaaggccacagatggcaaccacattggtgaatctcaggctcaatgctcagtcctcacccttcccgagtgaccagcagcatttgacaacttggtcacttctttcctaaaactccctctcctcacttgcccagcctctttgtttttctttctttcattttctcatctctatttaaaaaatccaatgtttctatacttctatcaaattttcatcatgtgctatattctatacattgtattgaatcgctaaagaaaacctcataaaatgcaaaagtgctagtaactcataaaagaacagaagaataaactcttctatttagaacctttgtctttccttcacctggtatctaatttcatgtcttcatttttagcaaatactaagaaagctccctattgactcaatgacagtgagcacatgggacttttctaattaagtaggttgggtacaaacccagctggttttcctcttacttcttaggcatcctcttctcagcctcttctgcctgattcctcctgatcatcccaaccactgacacttggtgggtcccaagcctcagccctctaaacacgtttcttatcagtctctgtagaccatgccagttgtcccatcttgtcttaaggttttaaacaccatcgcacgctaattgtcaatgactctcaaatttatatctccaagcttgtgccctcagctcaagattcacatacccaactgcctactcaacatctctacttggatgtctcatagtttcttaactatgagtatccatgaactcctttccttgtcttgccccacagatcttccctcagtccttcccattccatgaatggtaacttcatccttgcaattgctaagtctgaaaatcacagagttaactttcactgtctctcactccataatcaatacttcaggaaattgtatgcattccaccttcaaaacgtcccctataacccaaccacttaccacctccacatctacttctggggtccaagtcactctcatctcacccatggattattgtaacagcatcttaacttagctccctgtttctgcccttatcctctacctcagggttaattctcaaaacaacactcagtgttgtcattccttcttttcatgtgaaccatatcgtgttacctctctgccaaaattcttcaatggctcccatcatatttagagtcaaagcctatcaaaccttacagcgttggttctctctggccccatctgcctctgctctcccccttgttccaatactcctttttgctcccttgcctcacaacatttgctatcgctgtgtgccaatatccccaactaccacctccaatgtgtattccctattcacctctcctgctgcatttttctccatggtactaagcaaatttaacaaaaactataattttcttattttgtttattgactgttttccttctagaagtaaacaccatgagagcaagattttggcctgttttgttcacagccatagtccctgtgcctggaacatggggaacgtgttaagtgatcactcaatacttgttgaataacgaggagttgaaattatcaaagtaaatgaggtctcccagggaggacatgtagagtaagaacagaagaaaggtaaggtgggtaaaggtagggaaacaactgtcaaccatcaacatttaaaggctagaataagaaacaagattcttgagagcagatcaaagaattaggtgagttagaaggatcataaggttgtagacataggctcaacgaagagccttaagaactgttaaagaggtagatgagtgtgtcaaacccttaatgccatttttaggaagatcaagagagaaaaggtgcacagccagcatgtacagagttaggatgtgaatgtcaggtgataaaataaacccagggagagtgattctatttttaaacagaggaaaaatgagaggtaaatggaggcaagaccagggagggatctgagaaccccaattcattagattaatctgtatcaccaagctagataattcatttactcaaagcttgaactatctaaatttttagatgtaaactaatttacttgcctacattgattaacccccaattcaccattttttcttaaaaaatttagcagcctatatattcttacctttcaattattaaatagtcaaatggatagtcgaggaagcctgtggaattccctttccctggagaaaaggaatcatccattcaagatggacaaatcctgctctgcctgggtaaggagagctggctgagtgatctgggcagagttggagtatatccctgtaccttactgcactgtgctgctctgggagcaggagccaggagaaggtgaggaagaggaggaaagaggagcatttagagaaggcacccacagcccaaagaaacctgcattgtgacacggatggacacagcttcctttgttggcaagatccggattagacttgtgcctgatccactggagcagagcctgggaagccttcgaggtgggcttgtccccagccagagaggcggaaaatcaatttggctggcaaacgagagcccccaagagcttagtccacgctccataatcctatccactagcagctcaggaaatagatgcctgagccctcacatattcatgggggatgtgaggcataaatcaggctttaaggattgggggcaaagggaatggactctctggctggctactaattaatcaagcacagaatacctaaacctagcaacctgggatggagccacacacacacagaagcagaggctgctgctgctgctgtttttcccatttttcaaaatttcaattaaaatagatatcagaagaaattttcccctttagctgatactgcttatgcatctccctgttcttcctttaattaaaaaacatgcttattgcaatacttgccagaatcactttaacggtattttaattgtaatgtctctgcctgattaaaaaaagaaaatatgaactagaaagtgtttgcaaaaatgttcacaggatgcaggacaagaatcagacacctccccagaatggatgccacatactaattccttaattagcctggtactgcagtcaaatgggcaatatagagaaaaaaaaaaatatatatatatatatatatgaaataaaatcactgactcagagctgcaaacaatagcagttgggagaaaccattttcatcaactcagatttccctggcggggtagggacctgtgcatccaactaaaaatgctgtgctcaagataagcccattcaatgtggccagccaagtttccactgttctttgctaaaggtctcatagcctttgggaaatgagtagttgggccaggctaattggcttctggtcctcacaattccatagggctccttttattgttttaggctagtagttctcaaacttgaacctgcatcagaatcacttggatgtcttaaaacacagactactgggcctcattcccagagtaggtttactgtagagctcccaaatttacagtttgtataagttaccaggtgatgccagtgctgctgactgggggctacactttgagaatcactactatcagtaaattaagtgattgttctaggtgtccgtaggctggtgatgtttggcatcatctgaaacaggctgagaaaatacaagcctggaattatagaataattcccttagtcactcaaccaacatttaccactagtttccagctcctctgctaggtaccgaaataaaaatgtaaaatagagtctccagtttctgaaggtcacggtgaagttgaattgctcctccgggtgaatggaaatgtgttggttttagtgaattgtcccactttagagatgactataagagaatataaagactgtgactcagctctttactttttctacaaaatatgaaactcattaaggtaaccttataactgtattaactctgtactaattacagagtgtaaacatatctgtggaaggcaaactacacagaaatatttaaaggaactcaaacactaagatataagtaaatgcctttgttattatagctactgttatcaattactacctaactaaactttgatttcctttctacatctagaaaaccatgacttattttatcaacaaagcttctagcatttaagtgctcaaggccttcagctgttccatggctttctaaaaagtcacttaaaatctcaagaagaaagctatttctaaggagaaatagaaaagacaaaaaaaaaatcgtctttttcccgaggtctgtaccaagcatgtaaaaatccccctagctactaagttcattcagataatcttcctctttctctttatcaaagttcagttagcactgacccaatctcatttttgaccagcctgcaatttgatacacctctctaagcaacttgttttttcaaaaggttccaaatataattattctctgaatattataaaaatgatttggtatagcataatagtattggaaataaaagcaaacaatacttttcttatagtatttattaattttaaaaatgagaatacagtacttcctacctttacctgaccccaggaatattgtatagaaactataataatgaaatgctcagtccccaacatatttttatctacacaagaatcccaaatacaaaagtacttcagatttctagctccacttccagtccaggatgaataggatatagggatcattaatgaacaaatgagatggagaggtaaagacagaccaagtcctgcatgaccctataagccatattaagtttggacttgaacttacaggctaatggaaagccaatgaaaggttttaagtaaggaagcttgaaacatttatctttcattactgaaaatattatagcttctctgctaggaagggactggtccctttcagtagcatttttcatgttacaatatccaagttgtcaagacataaaactgtaaattgtttaatatctatctatctgtctgtctgcccatctattgaaagcatgtcctttctcatagcaatggcttatctttcatttaaggctaatcaagtgtgtctgggactgttctctggaggtaaataatgtaagtcattgtctgattggaaaaataaggggtctcagagccaagtgtcccccacattaaaaagcctttgtctctgatctcctgatacacaaatagtaaataaaattggtcactgtctggactaatccactaacatttgagggtaccaggaaggactctgattatagagaaattctcaacaaacatgaatctgcctcttcaggtctgaaactcatttattagcttattcattcagccattatttgagtacctgtttcgtgcctggagataaaatggtgctggcaacacaaaggtgagcaaaaacagagctggcccctcctttcttcagcttacagcctagacctttataagcctccaaaatggtagagggaagaaaaaatacaccttgatattctatttgtaaataattaatataaaaataattcaagtttttaaccaattaaaaattctacctgtgatacacttagctttgaatatcagcaaagttcccctcccatgaaataagtaacacctacttgtcaccaagaaaagcccagcacatgaagacacccaagagttaagagtgaacttcaaaaaaactcgggctagttctgatgctaacttcttcatcaggcctcccttctggataatggcacagaccagccccttagggtaccatgcctgccaaatataggaagaaaatttactcattcctatactgctcttcctccacagagttgcacacacacaaacaacattaacatccagtagaggtttatacaagacattttctccctacacagggaagggaatcaccattatttccattttgtgcattgatttgaggaccagagccttacccaaaaccataaaagagtctgtgactgactcaaatttgaagtcaggctccagtttgctgaccaaactgcaatgaatcaaccttgttgtattgtctgcacataagcatcctatcttctggcttgaagggtagctacgttttgactacaaaagagggcaattcagtccatcttcttttacagccaacttgcagataaattattttgaatttaccaatttgcaacaatgtttccagcccacaaaaccctctcctgttgaccaagatattctacagttagagaaaaaaaacaaattattgttgaatatcatatttttatcaaaattactgccttccttcagattttgttttatcctaactggtagctatgaagtcttgaaactataggcagagggtaaaatgccaagtgactcacacaggcctgatgcacaaagagatcacaagcaacatctcaggaaagttctgtgttgtaacatttctagataactgcattggaaagcattatctgaagcatgcatctactgaatctgaggctggcttagtgctaactagaagcaaccaagtatacaatccctgggattaaaaaaaaaaaaggctgtgataggttcatcatttaatacctcactctgaaatcctcaaatgcttgtcaaggatgaaggaattctacaatgaacctgacagtgagtcagaagaagatgcttcatttcaataaaccaagaatatgcatttccatgacatagaaaccccagatgtaatggacttaaaaagatctgaatgtcctcaaaactgtgaactaaaaaacagttgagagaaaatgagatcatgttccaagctacaccagaaaaacatgtttctgtgaagtcaaagtaacaaggagaatgccggcaagcaaatggatccacttctccatccgtccctccctcgcaatagaaggaaaaacacttcaatatgcattctgaagataacagaagcaaaagcaatccaaggtctttattacccagctaattctttcagtaatccagtttgctttgtatatagaagcagccactatctgtaaataaaattgtaacttaagcctgatattcagccatatctcctgttatctctgacagtccaaaagtaacaaaaactagcattaattgagttcttactctggaccaggctgtgtgctaatggctttacaaatatcccctcatttaatactgaaaacatccatacgagacaggcaatacattgtgatattgccatgcaacaatgataaatgctagctctcattgttactattattgtcattataaccaggtatcaccttaatgaggaaaaacctgagacttacagaaggtctgcaacttgcccaaggtcacagagctgggaagtagtggagcccagattcaggctcagttctttgtggctagaaatactgccaagcatttaactgctttagtataagccagtagaccaaaaaatagaaaatcacattaaaggaaaccagtgcactattaagcagcaacagagactggaaacaagtttctgctcagacacaagcactggcattgtgagtagtaagaaactacaaactgtcttccttttttattgtatatatttaaggcaaacaacaggatgttttcatgtgtgtatgtgtgtggataaatatgtattatatataatgcagtaattactatagtcaaacaaattagcatatcaatcacttcacagttaccttcttttgtgttgtgtgtgtgtgataggagtacctacacctaacagctcaacaccaaggagagagttcattctcccctaattgaccctttcattaatcattatcgttacactacttcacatcaagctgcttgatgaccagatcagaaagagattcattgcttcattcaggaaatatgaatgtttccccaactacagaccacaacccaagatccttgcccgggatgcagaatgctctgacaagagggtaacgttccttctttgtgattatggctcatcataattacttggaataaaaataataaattttaattcagcaatgcctatggccattgggcatcttaacataaaagaatgaaaatataattaactaaatcaaggcaatatgcctatttccatcccagctcattagtattaattgattgggttaattctcttttgtgtttaacggtgcccctaaaaaatattttttttttaaaaaagggagggagggcaggaaggagggaagaagtagagatagtaagtagacaaaagttctggatctttttctaattaaaataaaataataaatgcagctgaagctcttatcacagtcacaaaagaatctgctactttttaagttgggagtcagtacatatagcatcataaataatgacacaaaacattggggccacttctcaattgccccccaaaaatttatgaccctgccttctactatataagtaatatgtgtaagaaaaaaatgtcaattctattttatagatgaaaatatgagtaaggcacagagagttcaagactcttgagggtccataaagtgttggttttcctgttgtacgagcccagttttctacatatcaggatgctggcttccatgaatggaaaaataatataaaggatgtaataccttcataaagtatttccaaatgtagttcttaggtgatctagtttcactgttacttagcagtaatcctttcaaaatatatatacttcatgtagaatgtattctttgtaatatagaaatggctgagaaagtacttccattataatacttcatattttgtcggttaaaatcttttgaagaaattatttttggcttgaaatttctcaggctttatctaagcctgcagatggtatcagaaaaagtaaagaaaatttcactcagctatttttctgacactgtgaatgtatatgaaaaagatagtaactaatatttggagggtgagttactgttgttgttgttgatgatgattgtgattattcaatcttatatttgaagagctctttattatctttcaagtactttcacacatattatagaccaagggaagacattaaaagaggtttacagctatgttacattgatcagatatttgaaagttgtagttcttcaccagtgaagactttggtcatatgccttttagaaacagaaatataacttaccaacagattttatattcctaacaattcatcataatatgcaaatatatatagacatatgtgtgtatgtacatattttgcgtgtgtaaatatgtatatgtgaatatgtaagtgtatatgtgtgtacttatacatacgtgtgtgtgtgtgtgtgtgtgtgtgtaatcagtgagaacaactaaggacagtgaaagtaaattagctgggaaaagtggtatttaagagagcaagggtttaaaatatacacttcttaaatttcacccaggaccatttacttgtccattctttctacaatcaacataaaatttttgagccttcgtcatgcatcaggcactgttctagaccctgaagagacaacagtaaataaattgatgaaatcctttgtcttttttgagcttattctagtagaggagacagactataaacaagcaagtaaattgataatataccatgtgatgataagtactatgaagaaaagtaaagcaacatcaaaggataaagagtcctggggggtggctgtaattttagaaatgatggccagcaagtcctcccagattagttgatattttctcaaagagcaaatgaaataggtgagccagccacatgaatgtggaagaagagcattccaggccatagacattacaggcaaaggtcctgaggcaggtatattcatagaagagctagagcagagtgaatgagaaagacaaggtcaacaaggggatcagaggttaaataatagtaaggaccagtgatttgattcccagtgagttgagattccactggaggttttgaggagagatttgacttaaatttttaaaggaaatggaccataaactgctgggggtttactttaccatatagcataaaagccaaatatccattacttaaacccatgaagccttattttcctgtcacaaaaagttatttcagaggtgggtggttgaatgccttatcatggcaactccagagtcatcagggtcctgggtttgtcctattcttccgcttttccattctaactaacaagtagcatcatggtccaaaatagtggccgaaaatgttgctattacatttatataccagcaagtaggaaagagaaagaaggaagggaaaatagggtgtagttcctactgggtcatctctacttttggaaatttctcagatgttctgcagggtacttcttctatctcatggtaagcccttagccacatggctatgtctagctacaaaagtgttcaggaaacagagcatttcagctgagtactttgttgccaccaatgaaattagggttttactactaatgaaaacaaggaatctgaaatatgggaacaaaataagaggcaatttaagatggtctaggccaaaaatgtggtggttaagactaggttagtaccaatgaagtgttgctacatgggacacatgttgaagatccagccgacggggttcactgatggggtggtcataggaggtgaaagaaagaagtcatggatgcctccatggtttttggtctgagccactggatgtatacaattccagtaagtgagatggagaatttcctcaaactttgatttgtgtatatgttaatatctatgtgatcgcaatatgtctcagacacaaatgatctgcccttcacctcctctccgctctccaactctaatcttacacaactgacaccaagattaccccagtatacattcggcctcactgccagcatcacttattttagaaccagaagttttagtcttttacatttactttctaattatttttctttggtaatattacatgttactgccagtattattcttcattttttcttgtatttcacacaggaatcctaggccactcaataagcattcacaaattatctgttgaacaaaatttgatctgtgtccttgccctgttctcattctttctagaagttatgacctatatctctatgataaaaacctcagcgtttcactctaggtagctctgtcttttgccaacaactcctgtatcttattcgtgcagaaactggaatctactacttagccttacatcctacctactcctcctccccaagagaaagaagagacccttcagatgacttactctccctctccacaggatgagggtttgcctttccaaacctaactcacttatctaaataatatgagagtgaaatattacctaaaccagaaatgctaagaaaaaccactattggaggttggggcaagtattgggattgctcagatatttaaatccttaagagtgagaagtcaaatgaatgttatacttatcctgcctttctcctacacttttctctccttctgatgcctcttctctgttttcagcctctggtgctgtcaacactattcatgatttacctggaagtaacagtacatccagagatttagtaatccaagactttcagctgggaaacttctcccaaatggtagtagcaatataaggccaagacctttgaatgcctgaaggggagcccatactcctgcagaatttgattcatatggagaaagccctggttaaaggcctgccaagagtatcttttctctgaaatgaggctttaggtctgtaattttcctttgtcattgctggtccttaggtagttgatgactgtctatagtggcattcccatagccactagctacacacacacacacacacacacacaaacacacacacacaaagacagggcaagagcccaagctgacagaccattttatcccctaaagggcactaattaactgatttgactgaaaacttctccttgctatagaagagaaaaaaaacagcttccagaatagagaatgacaaaatgcctaaatcctgattcggtctaaaagagacaggtattaaaattccattagtttatcctctttaaaatattttatttttcccctcatgtagctatattcttatcttaataaggatgaatgtttgtgtgttaaatatatttatagtaaagaacagtgttttagtgcagagtttcatagagatccataactaatcatatctcccatgtaattttcatttgccaatgaacagaggcattttgataactattccttatttccagccactaaagtaggccatgatttttattctcatttagcagataaggaaagaaatgcacaaagaggtgaaataactgacttagccatttgaagatgtggtagtagggttgaaattcgaaatctcagcctcttccaacttcataaaccctagagctatatagccggttttgcaataagaaagcctatttatatgactttccatgggaccaagaagtcaaaaccacaacagggtaaaagcaggaagacatggctttcttggcagggtatttcaaaggcagcaacgttaaccaatttcagggcattttgctatattgtgggggctgtcctggataagcatgactaaaaagtgcttgaataaagaagcatattctttgagaacactgttaaccttcttgtttttgaaaaattaaactaatcaagctctgtgcttataatgagtccaaagaaaggcctttcactttgaaccctctgaccacttcttcctttacatagtaaaatttcagtttggtctgaggataaattgtcaactaagttctggaacttatccagaaagtttccctcctccatcccccctacaagtgatataatcatatagaataatattaccaacctacaaacttcacacacctttaatgtgcagtaagttgaggatgcttgtgttagtgtccagcagaagcaattggccattctccactgtgacgttgtcgccatcttgtggcagcctttcaggaaaccagctgtgagtcctggaccatctccggcagaactgtaaagaaaagttgccctggaaaacagagagctgggttggtgggttggttggttggttggctggtctgttgcttcgttggttggttcgctggtttgttggtttgttggttcattcattgtttttgggcgggatagtataagtattgaatcaaaatagaaacttctcaaagaaagtaaaattaatttaaatattttaaatgtctccataaaattggttacctctctctttttcatacaactaacctaaacaggaaaaaacatgagaggcaaaattatatttgaagttcttctgtgcccagcccctggaattctccaataacatgctggtaatgttttcttgccttttttttcccctctagcacaggccccattctacctaacagatgagtttgattccatttatttttacagatatgtattgaatcttggacaaaaagtcataaatagcctggaatagggagaattaaaatgttctgcttgatgggtggcattttgctttatgtaattggtatcatttttcactggctctactgccaagagtccctgttttataggaacattcctcttcctaagtgctcagatctatcctcccactcggccttttttgatattattgttgcctttccccctgtgcctggtgcatcagggctgaacaaagcccatgcaggcataggcagaatgccgactgacttcagatgacaagtaaatagtctggaacatttgagtgaggggtagggagctgtactgacagaagaagccagaaaaggaagcactccctctccaccccagccttcagtccctctctcagaacttttggctttcctgttaatttgtggtcactctgatgtcatacgttttttaaaacagggacataaaaatcacagaaagcaatattgagctcatgcaagaggctggtaacatgtctaaatgccttgtgaagttgtagaagtataattacgataaacataataaaatcacaatagagaaggtgattccttcaaggtaatagatatgacatgtataagccactctctccagtcttcttcccattcagattccaacaaatgtgaagcccaagttcctataaaaataaaccacctagaaggtcctctcatgatgtgttagaggcagatgggagaagatcattagaagggaaggcatgtttgtaataccgacaactacacctacacagagaatagtgctctatagtatttctgagatagaaaatggaaaattgtgttgccagaagagccgttacgttttccagaaaaagatacaaaccccaaggtcaacagtgctaagttgcagacccaacacaatcactgagaaggctttgcaatttattcgttttctacatctgcaaagaagtaaaagtctatgactcatcacaatttaagagatggaaggaaataaggcatagtgataaccagttccagtatcacagaaaaaagaataggtgatccaggagcatcgttgtgaactgcagtatctgtaggctacaaaagtaggagagaattttaactctagatgatttcactataggactagctttaggttggtaaaataataaacagtacttcttataaggctatatatattatacattcttataaccctttaatttactcctgtagaatacagaaagaggaaagggaggcaaatcaaaggaaactggaatgaaagaaggtgggaaaaacagagatggtaaagtaaactgcagaacagggtgaaccaggttatctgtagtgtcagctgcgagtccatgataaaaggacatttgaaaactcttggatttccagaagcccagagatggaaaggactctagcaaaatcctatcccataattttacagatgctattttaggcagtgttccttagagcttaataaaatgtagatttctctagtgtcatcatatacctgtgaaatcaaaagctcaagaattgggacccagagacctacaattttaatgatcctctcagatgacacttctgcatcaaaatttaaggatcaattcagagcaagggctggaggagaaggagatatatctttaaaaggaaccaagatgttttctccaaaccaacatccaaagcttagggtctttggccaggatcgcccaaagactagcaagctaggaagaatgatgtgttgatgaactgtaagaaatatgaagacttcagcagcataacgctttctgagacattaacctggtggtcagatccataacccagccacagaactatgaagaaaaccagggctcattacacacacagtaaaatgatcgggaacaactagacattagttagatatttaagtgggtcaaaggtagactatttcatggtgttatccattaattaatttgagaacatttttaaatttttatgattagcacagatatctgttatctagctctcaataagctttagagactttcttgctctgaagcacttgcttatgccatttgctgccttccatgtgctataacctcttggcctagcctgtcagccttcaaagattgctatacttggtcccaacccagtaggtggaaaggtcaaatactgttatctctactttccagtggagaaagcaaaggctcaaagtgtttaaatgatgtgtcaaagttcatagtgatggaggcaaactggagtcacaaaaaggaagctcccatctgaagtttttcccttaccatggcctctcccgggatgctctttcccaaaagatctgcatggctcactcccttacttaattcatgcctctgctcaggtatcacctccttacctgtattattatttttaaaaagcacccccaatcattccttcattccttctcccctaataatgcctcattctagtattaaataatacaattccttgcatatttggttatcacttactaagcttactcaaatgaagcagagacttggtttgggtcattgctatattcccacctccctaaaagatgtctagcacatagtagttgctcaataaatgtttttgaataatttattaaatgaatcttatacctgctggtgccatacatgcttttacagatatcacacacaaacacacacacatctcttcctaatgcaataggtgaagatacaggtgctaagaccttaaaaatgctatatcccctaggtcttctgaaacatttacatcccttttcgtgttttcaagctccatttaaacataaaccaaatgatgaatagtgctacttaattggaacctgagactcagattcgatctcataaaatcttccaccaattttttctttcaccttaagtttctctagtcaatgtggccaatttcaaatgaatacagatgtttaagcattcagtttcaagagacctaagtttccttgtgccctgaattccccttagcataacaaagatatcttgagatgtataaatgtttattgatgtactcatgcttttacacaaaataattactaaatactaaaaaatctaaaaattactgcagcatccactgcttaccagctacctggggaaatagaagagcagcatatctctatgattgcaagttatcagtgtaatccatgattacatgcacgttgccataagaattttagctctcctacattttcagttaacagagctggtgctatcattccctcccagggaaatgctccatgaaacagtgaggatggctcaccttccaacatcttcatcctccaatccatgtcactttgatccaatcaagaaaaaaaaaatgccaacagcattgattaaagattttgtgaatatatttgagaatgtctctgttgataccaacatatttttggtgaaggccatgttccgtgtcaacagcccagcttacttccacctaatataagctctttcctctatagttcccatgatgctcagcctttagctttagtgttcttcctggagataaacacatcactcattcttattctgcagatgaagaaaatcaattcctcataggcatatgggggcagccgtgaaaatagagatacaagaattgcccagaacgtgacctcatctttgcatctagccccaaataaaccccaaaaaaagcagaaaaaaactttcctgcctcagctaggaagcttatgcaatttgttttcttcttacagcatgtcagcacttctctgaacttcagggaatgtgcagtgtctgcaaatcttacatgtcaccttaaatgtacttgcaacaccaccagagttatcttgaaagaagtcattgatcagcaagttggaacacccggcaaagcaaagacctatttgtgagtgtatgcattgagctggggtggcagaggaggtggcgtatgggaatctctgtaatcacagtgtctcctggctgacaagaacaagaaataactgttctgacacctcaccaaaatgtcttcttcctcagcatccaaatcctggaaataggaaaagacaagtccctgtaaccattttctccactccgtatccttctttattttctccaaagcactcatctctacctaatacaatgtatactggtttataatcagtcaacccctaatagaatgtaagcttcacaagagtgtcttgcttttctgctgtatccctagaacctacaataatgcctggcatctattggctaccccaaaaatatgtttgaatgaataaatggtcaactcttatttggacttatgatgccataatgaaaaatctttaataactgaaataatatgatatgaagctataatttaattttgttcagttcttctttacattgaaatgttttaatttttacgaaaccaactttatttaccttttttgtgacattcttcattatgttatagatgaaacatcctctttcaccctgacataaataacacttatatgtccttcttgattggtgggttttatatctgcatgttactcctcaactaacttacaatttatgttgatggaaagttttatacttttttcttgtttttattccttgctatttttcccccaaatagctaactgattgtcttcataccattcattaaataacatttattctcccaattaatactcttggctattttaacagttgaattataatgttcaatgacattaaaccttttggccaattaaaatcccaaatccttttgtatgagctaatataaaggcgtttctcccaaataaatgtgacctcatccttgttcttaaggtacttatattatcatttagaaaaatacaaatagccagataattaaagtgtgattgattcaataattaaaggcataaccaagatgctatgggagttcagaggattagatggctgaccacagtggagatggccttgcaggggaaatcaagtgcattaaacatcgttttctctttttaatctggacacaacagatgacacaggctgagattatttcagctgattataaaacaaaagatagtgtagaaaagtcaactatctacaaatccaggattatgaatagagcccctaacctataatctaataactctttagggaccaaaaaggaaattgaattagtttggtataatttattcttactgacctcatgcaggctctaagtgatcactttcttttctcggtggttataaacccctcatgattacaagataacatgagaatgtccttccacactgcactgtgtagcacattgactactcaaagaaatgtcaacagtactttttgtcagagattcctgcccagttcaaattgaccctttctcatcattagaaaaccaggcaattcattgtcttatctcttggttccacacacttcctatcctctgcgatttctcaaaggttgctgactctacctcagtgcttcatatatctaagttattagccctcttaagcttcagaggattttcaaagtctgcagacaggacaaatttacagtcttcttttatcgtttcctctatttgaatcttcaaatctcctctaatagtatctcttctgaattttaagtccaaagaccttttcacttgtgggagaaaaaatgataatgatagctactgattacttaatatttctaatgtcccaagcacaatgctatacattttacttacagtatcactaatccttatgtaaaccctgaatatctgagacaggtctcagttaatttagaaagtttattttgccaaggttgaggatgcatgcccatgacacagcctcagcaggtcctgatgacatgtgcccaaggtggttgggacacagcttggttttatacattttagggagacatgagacatcaatcaatatatgtaagatgtaccttggttccatccaggacaacttgaagcagggagggggacttccaggtcacaggtagatgagagacaaatgattacattcttttaagtttctgattagcttttacaaaggaggcaatcagatctgcatctatctctgtgagcaaagggataattttgactagaacggaaggcaggtttgccctaagcagttcccagcttgacttttccctttagcttagtgatttgggaggccccaagatttattttcctttcatactcacaactaaaaaatgtaggtattactctttccacttaaagtttaattaataataatggccaacacttacggggtgcacttaacaggtattatctcattttgttacagactcttttcagactactttccaggaactacagagtagatggatccctgccttcaacaaatgtttattgagcacccactacacaccaggcacaaaacaaattcctgacctcatggagcttatattttagggagataacaggttaaatatataaaactaatagtgtgctctgaagtaaaaaagaaacagggtgaagtggatcagaagtgccagggtaggaagagctatttgatatggagtgatcagagactgctctgattggattggattggattggattggattggattggattggattgggaaaggagcagagaagtagagtatgagccagaggctatcaaaggaggaccttgaaaaaagggtgtgcttggagtactgcagctgcagcctgaaggatcaggcggctggccctggaggaaggaacgctgtatagccagatggcctttctagtgatgcaatgagaaacactgcacaaagacctgggtagacatcaagttcttcatatgtcatagaaaaaaaaaatcaaggaaaacactcagtaacatataacgaggtcagcaaactacagtccacaacccactattttgatattggcacacggcatgacaattcatttacatattgtttgtggctgctttcagtttgtgacagaagcaacatggcccacaaagcctgaaatatttactatctggctctttataggaaaagtttggggaccccggtaaattctgtttcatactatactatcagtatagtacctataatatgctcagtatagtgtatctatagtacatcagtattaaaacatgcgcaaaatggaactttctgtaattgaaaataggtaattataatacagctacctgagacttgagggactgcaaacaaaaacatcttagtgaaggatatacattaaagtactggaaactgattcaattcttcccattttttagtacacaataagccagatctcagaaagccacagaaaggcaagtggaagtgtgggaagttgtgtgtgtgtgtgtatgtgtgtgtgtgtgtgtgtgtgtatgccactcacgcactcacgtgcatgcacatgaatacacacacacacacacacagagccagatcagaagattgacagatacatgctagcctttttcacaagctaacacactgccatttaaccagcgagcatggagcacgtgtttgtgttcccagtcactattaagagacaaggttaacattttaagtgatggactacaacatgttatttccccatgcaatggacccatgacggcactgccttcgaaaacacttaatttcggtgattgaatacacaggagcgtactttccctgctatgaacgtttgacagctccgcagtttcatacaccaggaaaccttttttttcctcctttgcttttttcctgtctttacacctgaagggaagcaaaatggatatgtggtggcagaggaaaaaggaagaagcccagagaatgaaaaccagcttatgagcttcagtgtattttaaaataaaagtattcactgccatctgctctaattacttctaatgtttgggctaccatcttcatacaatagaaataatgatctcctcaagggcaaaaaaaaatttttttacagaaacaaacaaaagttgattacatttagctcccaggctaaagaagcatcaagctactttgtagtgaacaatcaattaggagaatgggtaggcctccgattaacactaacaaattaggtccttttggtggttccctcccttttcttcttttcctgcctctttagaggagctgtgctcacagctcactgagggcaaagagctgactaggcatatttctggatctagggttattccacacaaattccttacattttgatcagaaccagataaggccaagtcttctccctgtcttcttgttgacatcagacatgtcccagctttaatactgaatatagggctgggtattctaccaagacttcggattacttcatggagtgaactgcttaggggccaccccagacttgaactcctctaaggaagctaaagcccacttagcctcagtaaagtctccaggaacagacatgatccaggccaggtccattccttagacttaagtgaaacacatggagcccagaaaaacatggaacagacttctacaatgccagcaggagaaacgttgctttcacaaaggctgagtctagtgaccttctcaaatcctcaaattcaaacatattacttgtatgaagcagaattctgagatgtcctaggattctgaacccctggtgtacacaccctgtgtagtcctctccccttcagcagaagtagagcctgtgaatatgatgggctatcactcccatgattaggttatgttatatggtaatgatgatagaattatgcagatataattaaagtgagagatcagctgactttgagttattcaaaagggagatggcctctacctaatcaggtgagtccttaagagagagattctcccactggccttgaaggagcaacctgccatgtggcttggaggagaccatgtggctagaacccaagaacagcctttaattgctgaaagtggtcacagccaacagccagcaagaaaatgaagacctaaatcctatattcacaatgaattgactttcactgacaacctgaatgaacttggaggtagaccttgaattccagatgagaatgtagccatgctgacactttgatttcagccttgagagaccttgagcagagaacccatctactctgtgcccagactttttaaaaaatttttttaatagatttagagggtacaagtgcagttttgttacatggatagattgcatagtggtaaagtccgggcttttagtgtaaccaacatctgaagagtgaacattgtgcccattaagtaatttcttgtcccaccttctttccaccctcccacccttctaagcctccagtgtctattattccactatatccatgtgtacacattatttagctcccacttataagtgagaacatatggaatttgactttctgagttacttcacttaagataatggttccatacaggttactgcaaaagccatgatttcactcttttttattgctgagtagaattccaatgtatgtgtgtatatatatgtgtacacacacacacacacatatatatataaatacatacacaccatattttctttatccaatcatttgtcattggaaacttaggttgattccatatctttgctattgtgaacagggttgagataatcacctgaatgaaggtatctttttgatataataatttcttttcctttgggtagatacccagtagtgggattgctagatcaaatggtacttctatttttagttctttgagaaatcaccatactgttttccataatggttctactaatttacattcccaccaacagtgtataaatgctcccctttctcagcatcctcaccaatatctgctgtagtttgactttttaataagagccattctgactaatataactcggtatcccactgtggttttaattttcatttctctgatgattactaatgttgagcattttttcacatgcttatctgccatttctgtgtcttcctctaaaaatgtctgtttgtgtcctttgcctactttttaatagggttgttctggtgttttgtttgtttgtttttattgagttgtttgagctccttgcagatactggatattagtcctttgttgtatctgtagtttgcaaatattttctactgttctgcaggttatctgttcattatgttgattacttattttgctgtgcagaaggtttttagttttactaggtcccacttgcttatttttggttttgttgcatttgtttttgaggtcttggtcataaatactttgcctaggccaatatccaaaaaagtttttcctaggttttcttctaggacttttatactgtcgggtgttacatttaagtcttcaatccatcttgagttaatttttgtataaggttaaagatagaggtccagtttcatgtgcctgcatatggcagtccaatttcccccgcacacttatcgagtagggtgacttttccccactgtatgtttttgttggctttgtcaaagattagttggttgtagacatgtgactttatttctgggttgtccattatattctattgatctatgtgtctattttaataccagtaccatgctgttttggtgaccatagccttgcagtataattcgaagtcaggtattatgatacctccagctttgttctttttgcttaggattgctttggctagttgggcagttttttggtcccatatgaattttaggatggttcttctaactctgcaaaaaatgatgttgacattttgatagtaattccatagaatctgtagattgctttcaatccgtgagcatgagatgttttttccatttgtttgtgtcatccacaatttctttcatcaatgttttgtagttttccttgcagagatctttcacctccttggttaaatatattcgtaagtattttatttggttttgcatgtgcccagacttctgatctacgggaccatagataataaatcggcattgttttaggccactaagatggtggtcatttgttatgcagcaacagaaaattaatatgccactataaggaccttcttgagagaacagttttcacagagaccatgtttagatttttccctctttattaaagttactgctcaaaagcataaataacagcaagaaaggtgggatgccagtgccaggcagaaggacaggttattcgctcactgcataaactctcctcacacaggacatgcaacatggaatttttcaatttatgatgccaaaaaatgtaaagtaagacctgatgcagacctttcttttgctcaggaagaattatgactaccaaagatatacagtaaataccacaaggacttctatgtagtcaccaatacttactatctaggctgaagaaatgaaaactttctgatcctgaacatggccaggatatgtgtgcttagggggataacgaagttttttgtttgttttttgggttggttttttttgctttttgttttgttttgttttgttttgttttgttttgttttttgagacagggttttactctgcacccaggctggaatgaagtggtgcagtctcaaatcactgcagactcgacctcctgggatcaagcaatcctcccaccccagcctcctgagtagctgggactacaggcatgcaccaccacacccagctaatttttgtatatttctgtagagacaaggttttgccatgtttccctggctggtcccaagctcctgagctcaagcaatccgtccagctcggcctcccaaagtgctgggattacaggtgtgagccaaccacacccaggccaacatgaagaatttttaaaggcccgtattctgactctatgtctgagaatgatatttgactatgattggtattaaaaattctactcttccactagcattgcttcctgagaaaagaggattttcttttttttatttctcattttaaaaaaagaaagataaggcaacaagtttcagggaaaaaccaagctcaggaacaagaaaaactcattctgtacctatatcttcactagccttgactaaataactttttcctagttctttaagcttcacgtttgaggtactttttagagagaaaaagaaattcatttgtttatcctcaaagcagcatcatgtgttcttaagctttctgcatgtattgcctggtatttgataatgtgcaaggttatttgtgttaatgctaataccacaaaattatcaattgtacctgaagaatgaggaaacccaggaagatgtttcagaggtggggatgaaatctcaataacctagaatttgagaaacttgcctatgcaatctgatgcagatgctttccttgtacgtgcagattttgtagaataaaaccatcaccctcatctttgtgaacatttactgggtgctcactctgagccaggaactgtgggacctagccttgtctgcatgaaggcataattgaatttctaagctcttagagcccagtttcaaatgcattgttccctttagcccaaacacatccgccacacattgtcccttttctgccaaaccctgtttattggttccaaatgcaatgaatcatttactgacttgagcaacattagaggtaaacaccaaggttaaaacgtagagataattgaataacacaccaactaccagtaacagcagtccaggcaaaagaggaaatagatccagagatttcagaaagggcaatctgataggaaccctccatgtcaggatcaaaaccgcatgccactttgacatgacagaaaaaacatctgcattttatttttttcaaaattgtatgtgccagttattaatatgggaagaagcagaaagcaagcaggtggtaacataacttaaataccccagtgattaaaaataaaccatccaaaaatcaactatcatgtatttagtataccaaaacagtggtgtaaagctgggttttttaaaaaatatatgtgtctgatttattgctttcactgttgatgaagaagattaataaaatatatgcatttcttttgcagtacacttttctctggagaaaactccagaaagcaaacattgtccaaagcccttccaaaaaatcataaagctcaatataacttccatatagcaaaatgcactttaatcatttactttacagtcacctggaattcattgtatgcaattcacataatgtctaaacttgggcatataacatatacacatacgtttataccaaatttcctttttacgtgtcctcaaaggcagaaaactcagaatctttggtgaatactaagcaatccacaggcacagttttttcccaggaagtccctcatagtttggaaatccaaaatccccaaagaccctcatgaaacaagacttcaagtgcaatagttaactaccttgggattcaaggctgaatttactcaataaaccatactaaaggtttatcaaagaccacaacacctctcagaaacatgtgcaaaatacattttccagaattctcccaactttggggaattacacccttgccaaaaatgaattgttcaacttgctgaggattaattatttatgtggctctgttttgctttaagaaaatagagatttcttttttccccgttttcccaactagaagaaatatagctcccaagaagcctctgtgttatagttcagggataatgaaagcttagctattggttccaatatctcattttataaatgtgaaactcagtgactgatacaagattacccaatgaattgaataggggtaggtcaggacaaacaccaaatcaaagtgatttttggtcttttaaaattttcttgatagagcaatcactattcatcccagtacgggtgaatcacatcacagaccccatgaaaaagggggcaagcaagaagcacagttttctattattctaccatttcccactcattgatgaccttctgatagccccctctccagaagaagtttcccttacctgggatgtacctaaagtagtgtttgtttgtttgtttgcttgttttagaaaattgagaaagaaagaaaaaaaaacattttttaatcaatcaccatgaaccagaaagaattaacttaccttcttactcccttcttatactcagcctctctcaagtctttaagcttctcatctgggcaaaccaaagcaaacttaaaccatgcttagtttaaataattattttaaaccttttgaacagtttgagaatatttaatgacaatgtaataggcatagactgttgaaagcttgtcctgttccctaagcaaccaggatgataagaagacacccaaagtatgtttagaggataggaggtcaatgtagaaaataaatgaagcttaacctggatggagttggagaccattattctaagtgaagtaactcaggaatgaaaaaccaaacattgtatgttctcactcatatgtaggagctaagctgtgaggactcaaaggcataagaacgacacaatggactttgaggacttggggaaaagggtgggagggagtgagggataaaagactatacacattgggtacagtgcacactgtttgagtgatgggtgcaccaaaatctcagaaatcaccactaaataatttattcatgtaaccaaacaccacctgtttcccaaaaatctattgaaataaaaaataaaaataatagaaagaaaaggagattaggacacagatacagaagaaagaccatgtgaagacacaaagagaggcagtcatcagcaagccaaggagagaggttcagaagaaatcaaccttactaacaccttgatgttagatttctagcctccagaatagtgagaaaataaatttctattatttaaacaacagaaaactaaataaataaaatttaaaaataaaacataaaaaataaaattaatgaagcttcattacattttgcatattaagcaagaaaattgaattttaaagatagaacttaggctaatttataattcacataaaagacgtttctttgtttttacttaggagaaatattaatgatattgtatttgacaatgatttcttggatatgacaccaaaagcagtacaaaaaataaataaataaattggacttcatcaaaattaaactcttttgtgtatcaaaggaaatcatcaatagagggaaaaagcaacccagggaattggagaaaatatttgcaaattatacaactgataagagattaatatccagaatatacaaagaacttccatagctcaacaacaaccataacaacaaaacctgatttttaaagtgggcaaaggacttgaatggacatttttccaaagaagatatacggatggccaataagcacatgaagatgttcaacatcactaattatgaggaaatgtacctcaaaaccacaagataatactttacatccattaggacagctatcagccataaaaaaaaaaaaaaacaaaaagaaaaagaaagtgaagtgcagtgttgcctatagtcccagctactcaggaggctggggcaggaggattgcttgaatctaggagttctgagctgtagtactgcactatgcactaagcatgtctgcactaagttcagcatctatatgggacctctccagagcaggagaccactccattgccaaaggagggatgaatcgacccaggttggaaaaagagcaggtcacaactcctgtgctgattacgagagtagctggagcctgcccatgaatagccacagcactccagccgggataacatagcgagaccctttctctaattaaaaaaaaaaaaaaaaaaaaaaaaaaacagaaaacaactgttgccaagactgttgagaaattagaaattagaactcttgtgtattgctggtagaaatgtaaaatggtgcaatcacaggggaaaacagtaggacaattcctcaaaaaattacatagattataattcagcaattctgagtatatgctcaaaagaattgaaagcagggtctcaaagagacatgtgcacagctatgttcgtagcagcattatttacaatagccaaaaggtggaagcaactcatgtgcattgacagaggagtggacacacaaaatgtgatatatacattcaatgaaattttattcagccttaaaaagaaaggaaattctgacaaatgacacagcatggataaatcttaaggacaatattatgctaaaagaaataaaccaaacacaaaagaacagatattgtataattccacttgtataaagtgcctattagtcaaatacacaggaacagaaattagagtggtagttgccaggtgctgggggaaggaggactagggagtcattgtttaacagattccagtttgggaagacgaaaacatccttgagacggatgctcgtgacggttacgcaacaatctagatgtactaaatgtacacttaaaattagttaaaatggtaaattttatgttgcgcatattttaccacaattttgaaaactgaaaggccaggcacggtggctcacgcctgtaatcctagtactttgggaagccaaggtgggtggatcacaaggccaagggatcgagaccatcctggacaacatggtgaaaccccgtttctactaaaaatacaaaaattagctgagtgtggtggcacatgcctgtagtcccagctactcgggagactgaggcaggggaatcacttgaacccgggaggcggaggttgcagtgagccgagattgcaccactgcactccagcctgggtgatagagtgagactccataaaaaaaaaaaaaaaaaaaacctgaaaaaagatgtttctccatatttgataaaatcaatattcttgggttctgtaattctatagatcaaaccctcagattaaaaaattaaacttacttagtttgttcagtgcttctctgtaaagcctatttggaattggggaattttagaacatctaacatcctcatttttcagatgagaacactgaagcccagagaggtaaagtgtctttctcaaggtcctaaacccaggtgaaagaatgagaaaacagaaaagaaggcaaccctcagtatatatgcttccctcattgctctgtgaagggtgggtttgcacaccttgtttctgtgtgtgtgcatgtgtgtattcacaagccctgtttacctgtccacgctactcccctactcccaacctgaaaacttacagaaatcacctgtagtcttcagatacactctgctatttcatgtcccatgccttcatttacagagcttgcctccattagcttcatcgagaacagcctttcacccctgttctaccagacaaactcattctttcaaagccaggtcattcctctttcttccagaagcttttgatattgtcccctcaccccaaagcagagctaccctcacccttcttactgcttccaccaggctttgcacatactgctgtagtccttaccccacactgccttacgaagtttagtatattgtagtattttctatttccactctctaagccagctccactacctaagccagatgagtggagctgcaagagaacctatgggagagcttaatggaaaaggcactagtatttgattcccacctggaaagtctaaagacaagagactggctggagctgcccttgcccagtggcagagggaagagggggcactggtttgggggcaagctacatgtcacctctggagagacaggcaaatgtagatcccaccaaagggaacaagctgatatgacttaaagagatctttcccaagaggcagactggattggtgagggagaagcaaagctcctcaccaccatcctccccgcaaaaaaatgggccagccattcagagagagttgcagacctaagatcccagcaggaggatctataatgaagccacagaaaatcccataagagagagctgcacctgccacacatgatgtctcctttggccctactcatctctcctctcaggccaactcctagaggaaggaaggaaggagatggagagaagagagaaacagccattccccaccccaccccacaccaaggtttccaagccatctaggggtgaaggagccttttaaaattagataaatttgggggtttcaaaattatattggactgaattggagttaagagattattagagcccatcaagattaatgtgttcaaaacacatcataagataaggacttcaaagtagtctttgaagactacctcagccaggggcatttcagtgttcaagggctgtcaaagccaaggaacttgcaggggatggactagaggtgaggaacaggaaacacccaatgtcactaggctttcaacaaacatgggctgtgagggaagaagaaactcagttacatgctaaaaggggccataaagtcaacagaggattaggggaagtttggggttctttatttaagattaaacagtttatgaactgagagaaatgcagaaaagagatgaggccgttttgacatcaggtgctaccaagcaggagaggaggtaatctagaatacaagtagggatcagcccccttctctgctcatctcacaaacactgtaagtcccaggcatacgtcctcttcttcctcatctgcacattcttcctggatcctgtcacctcctgtggcttctattatcacctacctcataacaattttcaaatctgtatctcaaactctgaaccgaaaggtttgaactgaaggagaaagtgtctcaactctctcctaaactctaaatggatggatatctccatttgtatgttaactggagcactcagccataacatgtgtataatgacattcattattttcccctttctacaaacttatttacttagccattaatatcaagtttacagagttaccaaacaccaaaaatagaatcacctgacttgtcccgtccttaatccccagcgtccaataggtaaccaagttgtgtccatgacctcataaatgcctcttcattcattcttttcttctctatgtatgcagttacatagagaagaaaagaccatacagaacatacagagtgtgtctgaagactacaggtgatttctgtacatcctcatgtaggccttagtttaagagctgctcatctctcaccaggatcttcttgactgtaggctccatgagaacagacagcatgtctgtttatgcatctagggtttattgcagcacttggtacatggtaggtttttaataaatatttattaaatgaatgaataaatgttaaatggacgaccattgattgcaacagccattctgatctctctgcttccaatccccccacatcctttcattctcctctgcattgctaatattctcttcctaggaaaattaacctcactcattcattctctctctgtctttctccctctctctctcctcctcctctccccccaacacatagtcacccacacatacagtcacccacctgacctgcctcccacacacacttagaatacacagagtgtagagcttagaaaagagctgactccagtgcctagagaacaaagtccaaattcaaataagtatctaatcctctaccctacaagtggtctcccagcctcatccctcgcttctccccataattctgctggatcatgtgccatcctcaagctataccaaaagccacagtgtcccctaacataccctgacttgtatgcacgtgttttttctctcctgagcagtccagttgttttccaaggactgtctccatttaaaatctctccagaatgatcttcttggaccctggagaagctatcttctctcagtgctgccctgcgctcagtgcccactgcttttgtgctccatatttacatcaatgtttcaccttgctagagtgtgagttttaaggacaaggactatatggtagtcacatgtatattacaagtcactagcacctctcctggtacataatgagcacttgccaaattaattagaccaaattcatgaattagacccatttattacccgtatgtaacaagcaacaaacaaatgggggatgtcagtgacaccaaaatgctttctcttgcctgaaagtttataatttctttgcactctgttaaaactatttcgtggtttttttcaaatattatagaaaatattcatcaaggtataactcaaactcctgccaccatgtctgccagcagaatgtcagtagacctgcttcaataaattgatagcacttatttataatttgcagcccccatttgcatgcaaataatgtgctacagttcataaagttgatttttctcttaagttaaatattctacctacaatgttgttcatgtatcaattaatgaagttttactatattcaacccataaacatttattgagccaggtactgtgctagacccttaggataaaatgacaaataacataattccctgctctcaagaagctcactgttgaaaaaaaccaacacacaagccaagcattacaatgagacaggcttgtttcttttcttacaagggcaaaatgtggacgtttacaagagaaggtagagaaaatgaaagctaaaaggtagcagttgtaggaatacttatcagactatgatcttacttgcagaaatatctcattacttggcttttaaaagcaatcatgcaaacttttgatactctgaacagtacagactactcaacatgatccctattataaccctttatctgtgagccaaatatcattgaaatctatgaacaataacaatacagtccacttgaagaaagtaactagattcctttaaatatcaagatggtagaatgtttacaattaacagcctttagtagcatagcaatatttgtccaaatcagtcagctttttaaaatgtctaaataaactgttggaggaaaaaataaaaagttaagttcctatattttggtcaaaaatgggaaaaagctacagcgtttataacctatttggaacacatgcctgcctctaaaaaggaatcactataaaccctcacaagaaacctctgacacaagatcccctgataaacactcaacctgcatgctcttcccactacactctacctctactccgattgcacagagtcttgcaaaaacctctgtgcaacccaagctcaaattcttcaaaggcactgcggtacagagcccttttagagaggctccaaagctcaagctctccctctccctctccctctccctctccctctccctctccctctccctctccctctccctccacggtctccctctgatgccgagccaaggctggacggtgctgctgccatctcggctcactgcagcctccctgcctgattctcctgcctcagcctgctacgcctcactggttttcgttttttttttggtggagacggggttttgctgtgttggccgggctggtctccagctcctagccgcgagtgatccgccagcctcggcctcccggggtgccgggattgcggacggagtctcgttcactcagtgctcagtgggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggctgccatcccatctaggaagcgaggagcgcctcttccccgctgccttcccatctaggaagtgaggagcgtctctgcccggccgcccatcgtctgagatgtggggagcacctctgccccgccgccctgtctgggatgtgaggagcgcctctgctggccgcaaccccgtctgggaggtgaggagcgtctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggaggtgggggggtcagccccccgcccggccagccgccccatccgggaggtgaggggcgcttctgcccagccgcccctactgggaagtgaggagcccctctgcccggccacgaccccgtctgggaggtgtgcccagcggctcactggggatgggccatgatgacaatggcggttttgtggaatagaaaggcgggaagggtggggaaaaaattgagaaatcagatggttgccgggtttgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgtcaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaataataataataaataaaaaataaaaaaataaaaaaataaaaataaaataaaataaaataaaataaaataaaataaaaaaaagagaggctccaaagtatccacatcttaaccacatcggacgcctttgcccagcctccctgaggctcccacaacacattctgaaatctcagacattgcttaagcagggcccaggaagcctttgcaagacaaaggaaggaaacacagtgaagtgtaccgttaacaaaacccaaaatcaaaaggaagtccaagtcgttgtcaaatttgtaattggtagctccattattaattaatttgtcagagaatttaacacagcaggactatccacagtcataactgcacaagtaaattgagactaggttaaacaaaatttttttaaatttaattttctacgtacctacagaggtgagaactgcctagactacaaaaaataagggggcttgcttgtattgatattttaatctgaaacatcattattgtgtaaacggaatctccttttacattagttttcagagacaagactggaaacagcatatgagcacataatcatatcacagtgtgtttctctctcaaaagccgaaccttctgccttaacactttcacagactcctccaggcctgcttcaaacagacaaaacactcctcctaaaactcaaagaaacatcgcaacacctttgtaataggcctatttcccaagagggggcagataaaaggacaaagcaaattaagggaaatgcggaatataaacttgaaacctactgtcaataaaacccaaaacaaactcgaagcggaggtgaagaaagcagggggaggaaaagcaatgttaaatggtcatctttcttctcattttatttgaggaagttaagtttgcacagctccttacaagctgtctttggctaaaatcactattaatgagctttgacgtttgaaatttaactgagcacaagctaacagcttccagcactgcaccacccatgaagtcaactggaaatattttgctagggcctaacggtgtgtttattgaaaaggcacagctttcaagagaaagtgtttatagcaaccactttacctgctatccctgctctgtgatgtctgtttggttttagggtttggggggtcctctttaactctttctagtcacactgttctaattgttttcaagtctagcaggagaatgttaatgaagttctttgctctacagcaacctggattataaggacagatttgaaaactctgagttatgacaaaggggcaggccacaaggcaaaaagaaaaaagcccatagagaggcttcagctctagcattcgctcattagaaagacaagataaaaacacgtattctttatgggtaatgccattaaaattatcctttcccaaaagagaacacagtgactagatcaataaacctgaaagattgcatggattcttcttagctaaaatcctggttcattgaatgaaagtgaattcattattaaccaagtagtttccccaagagaaaggcatggaaggaagctattcactttactcctcaacaaagaaggctttaggcattctgacttgtttaagaagtaaaatgaaaaagagggattgagtctgaaagaaaagcatactcacacataccctgctcttgcacaaaatttacatgttgtcagtttctacctctaaaatttattaaaacaaagagggagcattattttgaatctcatgccacagtcctaagaacaatggtctgtgttcagtgatcctgtacagattcttgaccttgaacacacctggatgccaatatcagtatgaaattcagaactgctcccctttccctgaagccagtgttacactggagaatgtaggagtatcctttgcctgaggcattcctggaccaagtaaaagtaaaagcagaaattataacctaatctggaatgcctctaaggaatggagaggaaatctcagttacaaagaaaaggaagttcagaatctgcgaactagaaataacataatttcaaggtttttattcaccaaattaacgttgggttacccctacaataccaaggagaaaacgtccaaggatggtgctaaatcaatgaagacaattcagacattacaactagagaaaaaataaggagaaagcaagaaagttggattctttgtccaaagatatttttgtcattactagatatttttccatagaaaaaaaaaacaattactagatcatcaattattttaaaattaaaatgaaatcttcatatgttccttttttaatggaaatgtgtaaactggtacaactatattattttgcaatatgcatgatctgtgaaaaaaattagaaaaaaactacatacaattgaaggctatctctgagtttcatatactttctcaaaatatgtggaaagataaatgtggaagatgtctgttgcagtattgtttgtagaaatcaacttcttgaaatatttattgcaaaacaattaacacatgtttattgattctttattttggcctactttgtaagaaaaatccaatagtgaataaacaatagtttctgggtttatggaacattgtttaagaaatatacaacaacgaaaaatttaagaggaatgaatgttataaaaaagaaagcaggccgagcgcggtggctcatgcctgtaatcccagcactttagaaggctgaggcgggcggatcacttgaggccaggagttcgagacccacctggccaacgtggcaaaaccctgtctgtactaaaaatgcaaaaattagccaggcatggtggcagatgcctgtaatcccagctactcgggaggctgaggcaggagaatcgcttgaacccaggaggtggaggttgcagtgagccgagatcgtggcactgcactccagcctgggcaacagagtgagaatccatctcaaaaaaataataataataaagcatatgctaccctaaatgataagacacagggatatcttttaaaatagaaaggtttcttttttactgatacataataattatacatatttaagggatacatgtgatattttgatactacattctcacatgctatatgagttatttatttctagaagttatacaatggaaagtaatttttaaaataatttatgtaaccatttgtgaataagaatatatttgtgatagttattaattcacaaatggtaccggtcatattaacaacttatttataatcagcatatttccagttagcaaagtgagaatgtaaggtaaaaacgtaatgggattaataggaataattttgctatggggatctgtgtagttataatgatttcaagttaaaaaaacagaaatgtaagtaatatatagcatttgtctctaatattatagaaatgccatattcagacctgtcgtggagagggacatagctgttctcttcacaatctcagtcatgaatatgactaatgagaaatgaaggggagaggtggggaatttatcacaatatccacacaccaaacctcatgtacttcttcaagatgtgtctttcaagactgcactcagaatcgtatatatctattaaaattttgttatcttgtcagttgctgaagaaaacaaaaggatcaattagaaggaagtaggggctactgacagcatccagatgtgagacttgcagtctgacagcaaaggaagggacgaaatacatcaatacagtcatgggccatttagcaatttcaatagcaccacctgggatagagttattatttttttaaaaagtgaaacaactgaagtttgtgctgatgatccagaggtatcaacaaaatatttgatactaccacctatgttcaagtaaaaggacagaaaagccttcgcaatgttttagaagttaatatcaaaaataaacatggcttggtattttgacggaaatgtttcagttgcctagcaaattaactcctgtggtatttctcattccccaagcaaaatagaaaagtgagatattaggaaactttaaaactggaaaaatatatgacaccgccaggagttttgtccagaaatgaaatttggaaatggcctttatccaacaaatagcgtggcagcatttgctaaaccccaggcacagcagtaggtgctcagactacctctggcacacacataatctagcaggaaacaagtataatagccgatactaggtagagcacataaatagcatggctttaaagaaagcgtgggtacagacgtgtagaaatgctaggtgtggttgattaatgccgattgtgactactattaggtacacaggatatgaggacatcaagatagaacaccaaccagcaaggctgagagagccctccagggttgagggcacagcagaatctcagagtccagttgttttctcactcacttcaatacccccattttggtagcacattaaataaattgatctggatttggaaaatagcaaactgaaaaccagaacaacaattaaaatattcaaagctgaaggtatgaggctgggagaaatgataataataacaagaataataatgataaacactgaatgagcatttattagatgtaggacactgcataaaaaccttcacttctataccctgtttgaacttcacaatgaccttccaagagtctaccttattagccctatttatgatgagaaaactgagaaatgcagagggaaagtaacatgaccaaaaacaaaacgctggaaagtggtggaaccaaggctttgagaatctgttttcagactttagcagcccatgcccttaagcaatattaaaaacttgtctcaaaaataataaaagtttcataaatctgaaatgatgaggaaaatatagcctcagaaacagaaaggttaaatcagactgaatctccagtcaaaaggtgagcccaatcagttttgtcctctcacaggaaagaagttctttttctaagaccttttttttttttttctgaaactgaaactgtgaacttttggtattctctgattctccagaagaccctcaagtccctaagccctagcaattgttttattttactagttgaataaaatgggctctggaggcagtaacacaaattcaaatcctaactctaccacatagtcactctgtgacctttggtagtcacctaatttccctgaagctcaatctcttatcttaaaatggagattttttgagggctcttaatgagttaattagtatacataaaggctaactcagtgcctgacatataacaggtgtttggtaagtatcattgttcacttcttgcctttctcaacttttccttaaactaaaacaaggaaaagatagatttcttaagatttagttgttgcatcaccatttatggaaaaacaaagagaaatgaaaacaaaatcaactttccttggtgatgaaaacgccctatgtcttcaatttgattctgggcttcacagtatatacatatattaataagctatacacttaagatctgtacatttcattataggtaatttatgcctcaatatataagacaaattcttgacaaaataaatttttattttaaatataatatctcaaacataataattaattctattggcaaaccaaattatccagcatatattttatgtcgccaattagaaacttaaaagtacaaaaaacacatactacatatttttcatctagccctaatatttcattcccccaccttgctcccactttaaacaatcctaaggaaatttccaacagccactgttttatttctgtactctgcaagtagcacgttccagttttctatgcgagccttttggccacattacagccaactaccaccaccatatgccactggagtccacattgataaaagatctaagagttgaatggcactttcatacttagagagggctttacacctgtagatccatttaaaactcaaaaaccttgcaggaagatatggttaagcactatcaccatcattgaggggaaatgatggctctgagaaattaagtcaaggacccaggaccttggcgttgttagggactaggacccaagtcttccagcatcaagactcacagcttttccattactcttatacctttgacagaggaagagatgacaagacaagtcctccaacttgtgccaactaacgatgagcctgcacagcactagctatagaaaatcaacaacataaggccaggggctcacattgttaaagtctgtggctttagaaaaggatgaaatctgcctaaaaaatatttctctactcttcccagagttgcttttggaagcgatatctttatatccaatacgatccttctcaaaggtgagtattcatgctgcgaatccactccagtctccagggcctttgccctggtactgacattttaccttctacaaaaacttcatgagagaaaggaaaaaaaacaaaaactagatttttccaggtcaaataaaaagaaaaaacttatactaattaaagccatactcttttagacaaaaacactatttcagttctcccttctttgctttttctgctgcaaaacatgtttcaaggctaaaaaggagccaattaaagtttctattatcatgaaatacaattctgttggtgcagtgatactgagcaaaagcaattttattcctgcctttccaaaaatacgtataggtacatgtgaaaacaactatgcatgcaggcacacctgcaggggtgtctctatgtgcacgtgtatgtgtgtagaaaggaagaccagagagttatcacagaattgaacctgcacaattcaccacaaataaattaataatggcatattatgaagatatattttcccattatctagaggaactttgttttgcctgtttttgttattatttttcactcgagtcatcattatcctacagagaggaaggctaacaaaggcctttgatttcaccacttctagagatttaaacaaaagacttaacaatcccaattagaccattaaaatacctcaagagaaaaacaaagaatatacagctatatctgctgaactcccagtaataactcaaggtctgtcttaattttttttaaaccagaggaaatgaagggatagggggagggaggaaacaagggagaaaaggaaggaaggaaggagggaggaaggaaggaaggaaggaaggaaggaaggaaagaaggaaggaagaaaggaaggaaagaaggaaggaaggaaggaaggaagggagagatacagcaatttcactattccacccatgcacctagcagctgcgtttattgttatttatttatttcctcccttttgagctagatcctttttttctcatttagtccaacagagattgtcctcctggtgtgaccttttattcttcccttttccttcacccctccaggctattgccctcatgccagtaactagataacacactctatcaaagatttttttaaaaaatcattgggaaggcactagggctgatagtggcatcaatcgtagcctgacacgagctggggtcaaccatttatctctttacatagcctgtggttactgcagtggccatcttgacttgctacatcttaacaaccttgtgcagatgttgcctctcccaacactgataatatctgctcccccagtccttttgctttccttgtttggcatatttctttgttttattctggtggacatcttttcataataaatcagggcaagaataagtgaagcccctcccgtgtttcagagcccttccatatttcagggcaagggagataattatgggctatacaaagaatcttgctctttgtaccaatattttcaaactaaaatcaaaacacttttgttccttagtaaatagtcatatccttgaagttaaagtgaattcatgtagcattgctcttatttcactggatatgagattttatcaaaagttttttatgaactcatttattttccattctatcccactcttttcccatctctctctctctctctacccccaaaataccattcactagcttttttttttgtaacttattcagcaggcagcatcatgattaagagaaagttgaaagttaggcagactacatttcaaactcatagctccaacattattagccacagggcctagggcaagtctcctaacattttgaagcatccgtttccttatctgcaaaatggagctaatactatctactcagagtgctatgaaaataagtagaaaaaatacttaaatgccatgtgtctgtcacatataaatgttcaatgtatttgagttgccacttactgtcttaaagttaatgaagagttagttgctcagacaatggaatctggtgccaagcatcatggacaaccctatatacaaaactcatctttactgccactttttctaccactgtaacttcacttatttgggtctccaagaaatctgtttaaaaatggaaatacacttgggaagttttagaccttataaacataaactttaaataagactggaatggaagatagaaacaaaagaaagagaaaataaaagagactcaaaggaaaacttggtttatgtgtattgtgctctaatttttaatacaaaccctagatgcctcacgccttctagaaattcaaataaatgtaaaatatagccactatgagagatacccaagttaaaactcaccttcacccttaaaattcccattagcagattcttcttttcaaaggataacctacataacatagtcctcacttaaaaaaataaaagtaaataagctgatagctgttgaaggtagacaatgggtacacagggctcattatgctattctctctattgtcacatatttaaaattgattattttaaaagttaaataaaataggccccaataaatacattgccttaaataggctaattgtgatgtatttccagttgtgccaaagcccagtaaagaatagggtcaatatcccctgatgctgaaagggattgtttcttaagacttcacagagaaatcttaaattgtactttaatgatggactttatggataaatatatagtcatagaaataaatatatcactccaagcattgccaatgttaatcttatgaccattccagatttattcactcaacatacagatagcatttttaaattatttcatcatattcctatacttctacacccaatgcctgtagatactgaaattaggagttactatctctaaactctccagcttgaagattatggggcaagagtgccaaagagcacaggctctggaatcattatgtctcaatttgagtccctgctctgccactttccagctgtgggtcctgagacaagcttctaagcatttctgaatggttatcaacctgtaaaattgagatgataatagtcatcactttaaagtttcattctgaggattaaatgggcagttcaagtaaagggtttcacacagttcctgacaagaagcaagcattcaattaatgttaccccttcccattattattagtagtagtagtagttctttacaataaaatacagaaatatgcttctctaggtggcatcatagcaagtattgaataccctaatatgtttttctttccatttttctcaatcttcccaaaacagcgattacatacttggttgtttcattttaatgtttgaaaagtatcaatttatccaagtgaagttatgaattctgtgagcagaagagatgaggcaaagaaatcaagaatcactccctgattcagtggtgcctggatttgaaagggtgcagtatgaagatgagtttaaacgctggcatggctctcccaatttccacacaatttccttgtggagaagccaccagtacagggaaattttagaacaattttaccaagagaaaagaacccagacccctgctttcttagtctcccctcaggcgtgggcactgaaggcttcaatgagaggctggaagactctaactgtggcccaaatttcatgccacatggcagagcaaggcttttttccaggagcagtgcattgttaacttatcagacacattaataaattcctatctcaaatgtgcagaaaactcacacaaaaagagaagcaagcttgtcttctttctgctccattccagctctgggttaagaaggtactaccttcagtattgctggtacaagggtcctggttcaaaccttcagtccctgcccccattaaaatgtaaaactagattcaaccatcacggagtggcaccagaggattgcaatttcatccagcatgatttttattagccttgcaatttcttaatgggctcccctgagggctggctggtagaatcctgcactaccagtccggatttgctacaggcagcttaataaacatggtatcttccccgtgacaattgtcataacatctgaccagggtgcagaaggcagagctaaaggttaacaaaaccactgctcaggtggcagggaggtgagtggggagaatgttggaaattgtaatctgaaggcaaaggctgcctgctgggttggtgattcttccagcctggccagagctcccaggagccgagcaggcagcttgctgccttctataatcagcatcttttacacatctcatcagtgtcactgttcctgacgtctcattatgcaccagaggtggaagtggacaggtaccgaacacttgaacttttacttttcttattatttccatggagcaccatgaagctgggagttaattaagtcccgtgggacaggcaatcagtgtcttttttgctaagttaaattacattatacacagatgcaaaaaagaggagaaaaaataatccctcagctgtttcctagttaatagagtaagttagaaatatgatgatgccaaactggaagctgaagttgatagctccttagcatacgaggtgtctaatgaagtcatatgacaaatccaccagggatctccttccttaaaggatctcaaagcacttttacaaacacttttaaagaacttcctgcctcaactctgacaaagttaattgggggatgatagtcaattcgatagtttagggaggaaattgtactcagccagactggagaagaaaacttccttggatgtataagatgttagactgaaaagaaaccttcagaggtaagacagaatcagacagtgtcaaagtggaaagggagctaaaaatgacctagcccaaaatttcccaaagtgttccacagagagccaataggtgttgtatggaagaaaaaaaaataagatttttatgaccaaataagcttaggaaagactggtttcaacagagtaaaactgccttccttcctgcaggactctccaagcttttaatgtctgactggacatcgatagaatcgagtctgcagcattcaccaaacttacttcactacagaacactttttttctttcttttttttttttttgagacacagtctcgctctttcgcccaggccggagtgcagtggcactatctcggctcactgcaagctccgcctcccgggttcacgccattctcctgcctcagcctcccgggtagctgggactacaggcgcctgccaccgcgcccagctaatttttttgtatttttaatagagacggggtttcaccgtgttagccaggatggtctcgatctcctgacctcatgatccgcccacctcggcctcccagagtcctggggttacaggcgtgagccaccacgcccagcccagaacacttttttttctaatgagacatgtttctttactaattgcttacagaattcacattggaacatgttgattttgtccagttacagatggggaaactaagaggttctttggttttgtttttttgggtttgttgttgttgttgtttgtttttttccttgagacagagtattactctgctgcccaggctggaatgcagtgcagtggcataatcatgactcactgcagtctccatctcctaggctgaggcgatcctcccacctcagactcccgagtagctaggaccacaggcacacgccactatgcccagctacttttttgcattatttgtagagatgaggtctccctatgttgcccaggctggtctcagactcctgggcacaagtgatccaactgcctcagcctcccaaagtactggaattacaggagtgagccatctcgcccagccatgaggttttccccagacgtgcctccaagcacacaggtaggtaacacccaagccttgaattaggacttagatcagccaatctcagaccactatatcataccacctccctctgtaacttaccaggaatctaaaacaccctacaagaatcaggtatgctctctggtcaccctgcgtttctttgtattactttcagaatactcatccttcatcctttttcacctgcagtcttaagacacctcatttccttatgttctcacccctcgtggaagcactgcctgtcatgtaatggcatctgagctccaagagaacagcagctacatgttttagaactcaccttacctgccatcaggccacagctcagcaagactagagttctgactctgatatgggatctaaggagcattttatgagacacagtggtggcaacaaaatttataaagcctctaacagctttattttcctcctgaattaaatctacactccttagtttggcactcaagattgtacatgatgttttccaacctttgtttctagtaactgccttcctggttactttctttcaaactttacactccagccaaataaaatcacttaaacgtaaaccatgttttcccatctctgggactctgtaagactagtctcttagctagtagacctttgttccttatcttcccttatccacatcctggtaatccttttaggccctaataaaatgccacactctctagggagtttccaggtaatttttccacccagaagatttctttgccttcactgattttccataacaaaatacacatatctttattatcacatgattatattttgcttatagcacagttagtgagtttttatatctcccctattaaatagtacattctacgaggtaggagttgtattttatttctctgtagacttaaagcaacctcccaaagtccaaagggatggactagttctaacattctagatattgaatgcataattttatctaggcccttcataacttcatagtttttggttgtctctcaaaacaatcatctgaaaatccctgggagggactcagacaatgcctgggaccctctgagtgatctgtaaatcatgtttcagaaggattaaagaacggcaatttttttttttttttgaaatggagtctcgctccgtcgcccagactggagtgcagtggtgcaatcctggctcactgcaagctccacctcctgggttcacaccattctcctgcctcagcctcccaagtagctgggactacaggcgcctgccacgacgcctggcttttttttttttttttttttcagtagagatggggtttcactgcattggccaggatagtctcgatctcctgacctcatgatcctcccgcctcagcctcccaaagtgctgggattacaggcatgagccaccgctcccagttgggaagtttaattaatgtttgtatagtatttggggagatgaattatgagaaaccgacactgtaacagactatttctttccctagattgctcttttctttattattagaggaaggttctcttgcatagaactgagtgatcagccatccccgttgggagctggtacatcataaaaatagctgctgtcattttgaaacaggaagacgcacatcacaaaagaaacacctaactgactttaaagtcctgcgggccactgaagatatgtgtgttttatgtagtcattatgctttctcatttggttgtttgtttgttaaaagcagacattcctactgaattctaagggagacttaccaaactgtttccttttcatttacctgacttatacagaaaaggtgacttgttttcaccccctcaaaatctcatgcaacagcaaggccttaagttagcaaaaggagaagtgaggagcatcagaggaagtggccttagtgtagctataaagagaaaagcaaggtcattgaggtcaagtgtttgctgacggcaatgtccattctccagctttccacttatcaacagcttcaagacttaccttccaggcatcactgctaccatatttttacccaggtatttgggatgggattagctctattctataagtgcacagtgatcactcattggccaaaaccaatcaacaaagcccattaccctgagcagagggaattttgcccaattaactcaagttggatcaatgagtcatgaagacatatttgttggggggttctggggaagaaatttccttcttctgaactgtgctcatgaaagaccctttcattcccatgtgatacgaataggaaagcaagtaggcctagaagctactgacaaccacattgtggccacagagaaagcaaccttaggttgaatctgacactctgcaaggcagggaagagacatggaaagagccatctcattagtgagccctgagctgctggatcaagccattcctatgactccttagttttcctgtgctgtgagccagtataacatctttatcatcggttctgtgagccaatatagtctctttatcaaatgatttgagtcatttttcccttgtgatttaagtcttcataacaaatttttttaagtaaaatttaaagagaaaaaatgaaagagcataagtttggaagctatctataaacagattatagagagctatggaaatggatgtaaaatatattctttatttgaggaaagtttcttgatgcacaatattccagtgtgtttcttagaaggaaataaatagagacttagcacaggcagaaatgccaagaatagtcatgtctccccagaaacttccactgtttgcaacaacattacaaagaaagtgattaatttctcagtactagaaaatcccacagaggatcttcagggcatcaggactgcagatgagggtggaaacacatcaccgatgacatgggaggagagtgggagtccagaggatgaaaagaggctgaatgatatcaaatgtccagccacctttcctcactaagtcccatcagtcgtttctgcctaatggttccatctcatagcttaacttgtcatacttgccatcaagaatgtaaatccagttctgattccctgtagactcacagaaaaactaattaaagacaccatgtggaatagagtgggtctgccacaaggctgcagagccacttgttaaaaatggtgtcatcagttaagtctggctagattgcacgtggcgataaataatcccaagttttcagcggagcaatacaacaaaagcttatgtcttgttcacacaacatccactacagatgttggcaaatctcttggacagaacaactgtcccccatatgttgaggacgtatgttcagcccacactctgggctatttagtcaacacagaaaaaaaaaaaaggctagagatttgagctccagaaattcagtgcttctacccacattctatacaagtcctatggccctatcaaacttcaaaaggctgggaagggaagtgcttccttgacctcaaaataaagaactggatattggagatcactgtcacagagggaataactgcaaagctgctgcaaattctcttaggtaaaggagaaaaggagtctaaaaaatcaactaagtatccattaatttgaggaggttactagcacttaactggaagtaagggaactcttcaaaatattccaagttattctgcatctcccatcaaagggagaacctgagaagactagtttagtaattataatattctagaaaggagctagagctttctttgtaaaacctatagaatcaaggcatgcctttcctgttgtttatttgtttgttttattgtttattttgtttggtttttttccctttttttaatgtatatacccttcagggtagtttattccctcattaaatggctacttttctcttttatcctctagaaaaaacacatttcctttcttctggtgtagctgaaatgatccattggtgtgtattttatggacaatatcttctcatctgcacacttttctgctgatttacatttatgttggctccatggagagatacaaccagaaagggactttgtggcattgttgggatatccacaaccctgccactagtctaccatcagctaactccagccaaggacagccaggggactagaagaggtgttgcctaaccctcctaccagcaaagcaattcaagaagacagtaactaaaataagctcttagaggagttgtgcctacacacccttatttgacctgcccgaggagattagctcaaagctggaatgcaccagtggaaaaagaacagaaagtggaaaaagcctatgcctgaaactaccattttatagagttaatgcaagttaacatccactcatacatacagtaataccattaaggtcatttctatctccaagtaacagcctttatctaaaaccagttcaatattcttcattcctcccaatgctcctgcctctcccttctggttccccttcttttctcctctaactccctgagacacaggagtttttgtttttgttttttttctgagctgattttcaattcgatgaagtccgtttccataacacttttaatatctgaataacccattcatctttacccaaatttcttcaccttccaggctccagctgctctgcgctatctggtcaaggttccctacatttcctaataaagatgtgcatgttaggagcagttactgtggctctttaaagtaagagcagacttcagtgctgtgggaataaaagcaaggtctttggaggggaagatttatggctgaatcaacaagaattaaaaagaggacaaccctgaggagaaaacccaagttctccaaattgactgaattgccttttgtatctcaaggctgagatgattatttgtttttgcaaatagaaatgctatgtatattagactcaaaactgataacatattagagctttcagcaaaataaaaaatgtttaacatgtctagtatagaaccacatatccaaacactgatgaaattcatattactccttactcaacacaaatacacaacacataccacaaccaccaccactaacacaccacaccacatataccactgaaacccattcaactactatctgagacccttcatacctgggaaaggaacctactcatagttgggtgcctttaattcttcatcaggcttcagggagatggtagtttactactatgcattcaagaaatggacctgtggaaaagcaagcttttctcgcacatgaagaattaaatatactgataaaataacatattgacatatcacagttttcacattctgttactaaggacttccataaaatctttccatgtcgctggtcgagaaatagcaacttgagattacaaaactgagttatccagtcacccaatgagtcagcaagtaaactaatttgaacacttctggttcttcaattaccaagcctcacctcccctgtagaatccaaagaatccccatgtgaggccattgtaccatctatagcaatttcatagcaagcaggcctctctgcaggatagctaaagtttcatatttggaaaggctcagaaaaaaaatgtaagcattatactcctatagtcaaaaacaaaaatcccatgacatatggtttcattgagaaaattacacacagtatttatttagaaaaaaataatttcaatttatgaagttgtactttagaaggaaataaataatcatgtcacattccaataggactaccttttgtctgtcattcatagggacattttcacagggctaataaagctcgcggttttccactgagcacagaaactgttattttaagataaaagttaagagtagtgtagctgagataatgcaaactcctatatggtgatgtaataattactcagtgatattataataaatttaaacacattgtaaagaaaaataaggacttttgggagccaaaatatgacaaacactcatcaaaaccacagccttatttactgataacatatcttgatatgagaggagcaggctaatatcataaactcatttgatacaaagagtccctgagaaacaaaagaggcacaattaacttgttcagatgagtttaagctgcattcaggctaatttcctgaattccctctttttttccaattagatatatttttatttatgtgtttgcagagtgtacagtttcaaacacaccaggggactgtacctaaatcatttttataatatcatatttaatgggaaattcaaagttgaattattttaacattgaatacagaaacccattcatatgattctaaatacttttggcatgaaatataactgtgtcattgctgaatagttaaaggtaacagtttatttcatattattagatatagcagacctgccattccatttctataaaataaaaatgcattataatgtttacattgattaataataataacaatacattaatagtagtaacaacatattacctaaaatcattggtaataatgtcctagggcaagaagattgtacaaacctaagaactagattttctttcaaatctttcatcatactcttgagagaaagacaggggaaaaggcaagaatttcttcctttttttttttttttgagatggagtctcactttgtcacccaggctggagtacagtggtgcaatctcagctcactgcaagctccgcctcccgggttcacgtcattctcctgcctcagcctcctgggtagctgggactacaggcgcccaccaccacacccggctaattttttttgtatttttagtagagacggggtttcaccgtgttagccaggatggtctcgatctcctgacctcgtgatctgcccacgtcggcctcccaaagtgctgggattacaggtgtgagccaccacgcccagcctccttcttttttaaaaaaagaaaaaaacagcaagaaacagaggtatgcaaagtcttaagttcaaataattgacaaagcctctttcacacggcaagttctgattatgacaacaccaccataaacaattatataaattgtgacactttaacttggcataacaatttacagagtactcacagactgattatctttcataattgtgtagtctcattatgtatttaaccaaaaatgataatccctggcacatttccagggctgtctatgaatgagacactgcgttaagtgcactacatgcattaattaattcttacaaccctacaaggtaggaattaacagactcagtgaagttaagaaaatttgcccaaagttatataacaagtaagtagaaggatcagcctcaaatccagttttattttagagtccaagctcacaactactatatcataatgccattgttgaacttttaggtttctcctactattatacgtttataggtactgtcttcctccctccaaaagctggaagtcagctagtaccaatcaattgaaaggttaagtgagttgttaaacagttgtagtcagacagggacattgctggaattagaagagaggccccaggagtcctgttcactgtgcatcctattctgactaattaccctaagaaggcaaagccctttcagatgtgaaactgtctgcctttccagcttctcctccccctgaagtaggtaattctcatacatttggagcctcatttcagggagaaaatacaggcacaagggactcagtaagtttcctccaggacagccaggtcaggggtcaatggttgagtttctataccccttttccctaatctaataactagctcaaccctgctttctgcagcacttctctctgcaggcacacaaccctgaagatgcacactaagtgggtctaaaaggaaaaaaagaaagaagggagagaaggagaagacaaggagggaaggggagggaagacaaaagggacaaaattgttttttgatttctgtaataggagaaacaaaattaattagggaataaaaagtattttcaaattagcctctaaatagctatgtatattataaagaaaatattaaatttgtcacatagctggattgcatgaatttcctagaagaatctccttaaacaaaaagtggggataaaaataagcagtgtggtttgccttttaaacagtaatccagtacagacatatatgccttcatccatccattcatcaaagaggaatccaatatgaagctcactctcagagagtgtaatgtctatttgggagtttaaatatttaaataaatacatgtaatttaaatgtaaaagagataaatttcttaaaacaagtataattaagaactatggaatttcccaagagaaaaaaaattcttcaactttaagaaaaggagaatcttcctaagggagatatgcattgaagagtctaaatgaattttaaaatataaatattttggaaaaaattatgatgacttaaacattagggttgtctgagagctattttgtagtcactagaaaaacagacgagatgagaaacctgtggagtcttggtcttgtcaaatcaagtaacacacttaaagaccacagctttaatcaaagtacctttaacttaagaaaatgatctctagtactaatgatagtgagctgtgaacatgaggaaggtgctactcaaccacaatatttatctgcatctcccctttcccttcctacttgtgatctataccagttgcctgcatttccttgatactcatatactccttaaccccccaaaatctggtttttctccccaccaatattgtcctgtggcctcaaatgtcactaaggacctctttattgcggtatgttttgattagtctcaacacacattccttcaaactcttccttcacctggattctatgacactaccacaagaattttcaaacatactgttatcaggagaacctttctttcatataagatcttgcctagaacttcaactgattaccatagctttatagtaagatttaaaatcagactgtaagtcctccaattttgttccttttcaagatagttttggctattttagattattgcatttccataattttttaatcagactggaaatttctaccaaaaaaacctattgagatgttctattgaaattgcattgacttaaatgttaatttggaataactgacatattaacattattgagaactccaataatggttctctttatgtttcttctgctttggattcattaagcttcttagatcggtgaatttgtagttttcaccaaatttagaaaatctttgcatatttatttatttagatttattttattttctatcccttctacctctcttttccttctgctactccaatgacacaaatattagactactttatattgacttagagattactatctatccattttttcccttttctttctgttcttcagtttggatagctttgattgttttgtctacaagttcactgatcttgtcttctgcaaggcccaatctaatattatctagtgaaattttcagtacagatattatttctttcaattctataatttttattaatttttgaaatagttttcattttcctgctggaatttcctataacttctcttgttgcatctttgttttcctttaaaacctttaatatgcttataacagttgttttaaagtccgtatctagtacgtttcaacatctctatcatccataggtctgttttagttgattgcatattttgctttttttctcaggttcttgattgtatgctggacattgtggatgccatgttcttgaaggtggagatttttttatcttccttcctttaaagggtgttgagctttgctctagcagacaattaatttactgaaataacagtttaattttgttaagccctgttttcaggatccattcagtgggtctagagtagctttactccagagctagaatattttattcctaaagtgtggcctttctgaggtctcaactcaatgccctggtgttgagtggggtttctccactctaatcagtcagcatttgaaatcttctagtactgtgctgttccaaagtactcccagtaccttagaggctatgttcacttcaagcctcccagtagctatagcctgctagacctcacagaaatatactcactacatgattggttaactatttggcaaaggactcaagggacccctgcagacttctagagttccttttttgcacagctccctcctctctggtatccttccctgcaaattccaccaatattagcagccctaaactctaatctctgattggaaactgagagcacagagaaatggaacccaaaaagagttttttgggtttccctgaactcaatctcagacagaaagccacattccttgactattgagtgtgttgcctctccattccctctgccatttccctgccccagttatctctcacctagctgagatgcttctacctctcgtcggtttaccaatcagttcatccatacctcactgccagattaatgtgactatagctcacctttgatcagtcactgactccttggggattacttgtcacctgctgaatcaaaggaccaaatgcttaactctagatcacaatccaatcctagcccacctttccaaacctacaactcaccattccccttcacacacaccatgctccttgctattcctgtgggttctagccttgctgccttgcgcatgctggttcccccaccagaaatgcctttcctctgcatgctgaatacctaaaccctgtccttcatagcatagcacaaatgccactggcgttaatagagcttagttggctgccccacctgaagatgacctttcccaactccgagcccctactctgtgagaggggaagagcatggcatacacaacacttcccagagtgaaggcagcaggacagatgccagccccaagagaaattctgggaataaagagttccacaggcaaagtttaggtaacagtccacaccacagcactccctagaaatccacattatgtattcacgtattgaaggatcgcaaaagtcctttggtaggaaaacctacgtaacttttttttttaatttgttttggtttaaacttttattgccaaccttgaaaagcaacatattaaccagttatcttgtgataagaggacaacttgccatttttcttagaatctagtaggcagtcctgcggccctaaagcatgtgggagtggctttttgctcacttggctgtacccctcaatgggaggaagcaatggaaagaaacgtttagcttacaaacacatcaggacctcaaattaagttgttgagccacttgatattctttaacaaagtaagtactgatcttatcaatcttcccacactgcctcacgccctcccatctaggtcactaaaaaattatatatatatatatattttagacggagttttgctcttgtcacccaggctggagtgcaatggtgcaatcttagcttactgcaacctccacctcctgggttcaagcaattctcctgcctcagcctcccaagttgctgggattacaggcaccaccacgctgggctgattttttggtttgttttttgttgttgttgttgttgttgtttgtttgtttgtttgttttgagatggagtcttgctctgtcacccaggctggagcacattcgcaaaatcctggcttgctgcaacatccgcctccagggttcaagcaattcccctgtctcagcctcccaagtagctgggactacaggtacccgccaccatgctcggctcatttttgtatttttagtagagatggggtttcaccatgttggccaggcttgtctcgaactcctgacctcaggtgatccacccaccttggcatcccaaagtgctgggattacaggcatgagccaccacacctggctgaaaaatatatttttttaattttttatttccgtaggttttgggggaacagatggcatttggttacatgagtaagttctttagtggtgatttgtgagattttggtgcatccatcaccggagcagtatacactgaacccaatttgtagtattttatccctcacccacctcccaccctttcccctgagtccccaaagtccattgtatcattcttatgcctttgcatcttcatagcttagctcccacttatgagtaagaacatacgatatttggtttaccattcctgagttacttcacttagaataatcgtctccagttccatccaggttgctacaaatgccattaatttgttcctttttatagctgagtagtattccattatatatacataccataatttctttattgactcgtttcctgatgggcatttgggctggtttcatgtttttacaattgcgaattgtgctgctataaacatgcgtgtgcaagtatcttttttgtataataacttctttttctctggctagatacccagtaatgggattgctggatcaaatggtagtctacttttagttctttaaggaatctccacactgttatccatagtgattgtactagtttacattcccaccagcagtgtagaaatgtttccttttctagtgttccaaggttcccacacaaggaattcttgaatttggaacagggacctggattgtagtcctgattaagcacttgttggtgctggtcttccccacgcccagataaccatgcatcataatactggtggcatgtttttcccaggccaaggtagggaaattgtacatcccaacatgggtagggtaaccatgtatcacatatgtatgacaagttgttctgttcccaagcccaggtagggtaatcacacaccccaacaagggtgacatactatcccagcataatcattcattgtgaaccttgcactctcaaaagcatcctggtttgggtgataaattacatagtcacttagttataagccctccacctatagacttcattatatccagttcctaaatcaaaccaaaccaccctaacaagagtagaatctagaattaacaattttcccattatacagaatgttgtttttctggactccaggccactgtgtgccagccatagttatttcctaacttccaccatattgatccagtcgatgcgacaggacgtgtgcctgagactcttgttctattctttagggtcccattggagctaaacgcagccataagttcagactgagtttgccataaatccctgccattgttccctcgtgtgcttctggctacttgatagggccctgctcccaatagactgttcgaaactatgacattatcactaacacttgagtgtaacacatcacatctgaaacctacaatgatggtacccatctcctctttaccccctcaggactggagttccctacacactggcactagacacattcctagttcctaaagattaaatggcttacttcccccacaatgactatagccacatgggttatgaggccagataactaccggtgtgacctttatcaaccacccctcattatgaatctcagttaactcatctctgaaatgaactggccggtctgtatggcatccaacattccacccagctgtgatgaattgactctatgtacccttttttgaaacttaactacttccacataaggcctcacttcccaaatatctcttaaaagtggggtctctttccatatattttttaaatctccttcagaacatggtagagaaccttgaacatggttggaactcaaatgtatgtcacataaggatttttaaatgagtgaggcatttaagcctaaaaaaaatcaaaattagactttgagatgatgggaaattaaataaatctaagaagtgaaatgatctggtcaaagcagcaagcactatagaaaaataaattcatatcattttctagcactatgactagtgaactagcactgccaataatggctaacattggacatttaccatgtgtgagatgcagctctcagtggcgcacaccaaccctatgaagtgggaactattattgaccctactttacagatgagaaaactgaagtacagagggtttaaagaacctgcctaaagtcccccaagaagcaagtgatgtattcaaacccgggcagtctagctccaaagtccatgcacttaaacactaggtcagcctgcctctccctctttcacaagcatttgcacatctaagcatcccaacaacaccaggttattacgcacccagcagaaactgaggcccagagaggcttaaagatcacccagtgtcacacagcagtctcagcgcactacaatacacttttgaaatgtcactgacagctgactgctgagaaacaggcgcagaataaagtggaagtgccactgggggtcagcggctctggagagaattaaaattggtagtaaattgaaaggaagaggtgtttgtgggggacacgatgaagcgagaagtgacagccccaggctatcacctgaagggaaggtcaaggtgagggagaagcctgcagaggccacagagtggacagttgaggacccaggagcatggaaaggtaggcacggaacagtttagtaaggacagaaaaaaaatgttgtttgccatcgcatacattttcagcaccagtacaaaagttatagaagaacacacattttgaagccaggaagctgacttttggattaggacagtttgactgcagcagcattcacaagagaatctggtacggcgagtgccacataataggcactcaataaatgtttgttccaaataaaagagacaaaaagagaaaaatctgagaactgctttcataaagagaaaggcacctaagggagtaggtgctcaataaatattattttttatctttgtgccgtgagaagcctggggagctgtaaaagattatctgatccatttccaaagagccctgagcctctgattgcaattctcgcaaattcccggggaaggctgtggaattcctctctggagacttacaaacatgcttttagaagagccacttggagggagtggtttagacaatttcaaaatgggtgaattgaggcagagaggctagaccgaatgaccctgaggtccttttcgtttctgatgtccacgtaatcccctcagaagctgaagtttccactctgctcccccatggcacagagatgaaccgaatggacctgcagacattgctgtcccgccaagctgaggacggctgagtgatttggaagccttccagtaggatctggttaaatcgtaggccatttattttgtgaagaaataaaccacagagagcccctttcaaacatgcatacagaaatcaggacaaaatgccaagcagattatctgctcagaatttgctttgaaagagcccgggcaacactcatttatttttgagaaaatatatgattaaccagagttaactatgaattcagatattgtgcattagaccagcttctcaaagtttgagcacatttaatattatatatcgctgccatttggactaaattgtttttttaatgtacacaatattacaaatttaatttgagctgtttgaatcagtctgtaaaaaagatttgattatacctgagtgttctggccccagcgtttccgtatctcagtaatcttgacggtaattggctgattgggcgtctcacactccatctctgcctcagtttccatggtaatgttacaggagctattatagatgagaacttcatctctttccaatttagggctgaaacgagaggggaggttaaatggggtgtcatcaatcttaatgaaatgcaattatttttactcttattaatcattgcaagccattagcttgtggcaactacaggccaccatttgtcaaattttgcaaatttctgtaattttgtttccattcttttattgtttatttgtttttccttttatctgcacaccctgcaatgaaaatgcaccatggtaaatatctttcactgaggcctttctcttttccgaatctattaaaaacattagcaaaagctactcctagcccagcttaacaagaaatgcagggacaatacttccagttccaaaaagggtaacaaacgtctgggagagtttttgtttttattttttttcttttccccttccctcttcctgctcttactcatacttagtgttgggggagtaattgcctgaatccccctagggcagatggagaaattggaaaacccacacaactggctaactggtccctaattccaactgtgaaaaaatgagctcatttaggcttgcaattcccccttcccagctgatggcaatgaggctctgttgctagcagtggaacattaacttagtaaattaattaaacttacttaacagcccagactaaggagattcaatatatgtgccagttatactaccagccactcgctttaaaagtcctcttgctttaaggggagaagccagactggatttaaaataaaaaacagcagtgtagcattacagaaagtctaaaaatatgccatctagaggtgaggacatggatagtgaagggtgtcatcctcaacaggtgtgatatttattcaagaatcatcctggctgtaggcatttttgcaactaactcaaaaattatcagtaataataatgcatgatgtttcatatttgtcaacaatttcacatgtatgatctcatttcagcctataaattaggaagaggtgtaaaaagtgtaacccaaagagatcaagagattctcagaaagtcaaacacagaactacggtagctccgaggtcaaaaccagatggtcctgtttcccagagcagtgctctcaagttttgaaatgctgattgaacatcagccaggaagatggcagatcccatgggaagaccaggaagggtggagagaagggcaaaaaggtcaccacttgagaaactgtacaccatgtcaaaccctaccatcttttttcaaatcaatgtcaaaatgttttcttccacaattttctagaaataatgagcaggataactagtacatctcaccacttaatcttcgcttcttcatgctaaaatattctccactctgtatctacctaagacatgacttccaaacccacagtcctttagacctaataatgtagactgtcaatatgttaacatcatgccacccatatctgaacgcagattgtttgggctgaccactgggactccggtctgcctttatctgagcctccttctcacggtacctgatactgtgttcattttgaaggccaccgtgcttatacttagatagtggtcaattcaaagtctcagagctgcagctttctgaggatttcaccatggtgtgtttgttcaaatgattttctgaggagcactggcatgtaaagcttaggctcagaagcagatcagctggatctgaatcccggggcagatggttaccatctacatgacattgaagacattacttcactaagctttggtttccacatttataaaatggagttgccaataatcaagtacctattttgtggaggtgttgaagaaactgagcaaaatgaagcatataaatagattagcatggaacctggcacacaatacgaatccaataaaggcagctcgcgttatagctgttggaggtagtagttttagtagcattattgttaaaaatgtaaatgtggaaatttacatttattattgttacatatctctcactggtttagacctgttgctcaaatttgttttgaatctgtagcctgctatctagctgtaaatccattcgctgatccttcgtccacagggcagacaaagtcacaggataaatccatcctttgctcctggagcatcagtcgtattccaagattcagaaaggaaaagcaaagtaatttaacttttaaattaaaatgcaatgtaatatttagatcaatacagaaatgtgatggaatcaaatgcaaaattcacgcagacttttaaaacacctcacttcagagcaacttgaggcttgcatcaggccactttgggctttgcacctagaacctttttttgttactgggggtggagaagtggttggaatagtttgtgaaggtctcccgctatgtttatatcataagtcacttataaacctatcagaaaggaaatgaagttggtttcccacaccatcacattcttcgtaaatcggtttccagatggctactttcatttctgaaggctcacaaactatctgatgaatagttcattctagaattttgtcagggataacaccaagcttagttgtctaaatttccagaattcctcctcttttttttaggttcatagaatatctgcccatcacctctgttatgtgaccccttctcatggttcattgccagcaataggtcctcaatcataagagtgagttttttgtacccagtttatgaatgatctgagactacagacttgaactcaaggaaagtagtgaccaacttccttctacatcctttcttggccttgggcttccacttgcctcataaaccttcttatgccctttcctgactcttcgctggcagaggtacaagtaaaatgggctgagtcactctaccctctgtttgcctgttaggaacacactgttttcactaagcatgttattcttgctctgaagagaattaaacccctttctgttagcttggactttttgtttaccagcttcagctcacacttttttccatatttgtaactaccttgctagaaatgtttttcattaaaaagccatcaccaaaattagctgagacaccaggatatccaaaataggttaacatttacaaaatttcaaagcttctaaatagctagctactcttccatggtttcttccacaataatcctatgaattaagaagcacagttggccatatttaaatataaatataagcatatatatatgcaacataagcatatatagacagagagatcaatatatgtacagatacagatacagatatacatgcatacacactgcacacacacacacatatttactttgggggatatggtttaaaatattgggtaaaaatggtggcaaagattgttctagtatctaagactcctgactcccaaactattgttctttagttgatctgattagatcctaaagtaagcaagtaaccttggctgtgctccttaggataggtagggaaaacaatttgcaggcattttctctccctcacttcccctgaagttgcttcctgtggctctgaaacctcactgaacccacaaagctcagccagggctctcacactgaagctgccagcacagcattgcactaagcacactgcatcagaagccttgagttccagtctcaacactgccatggcttgactgtgtgactttgggaaattacttaatcttcacttagaagagaatccaaactctttactttggccttcaatgccttacatatctctccgagctcatctggggccacttttcctccttctcagtctactcccaccctcctagcctctgaacagtcataaaactcgacagttcttttgcatttgctgctgccactgcctcaccctccataaagacacctgcttctcttcgtaacataaaagacttcttcagagaagcctcctctgagtacactctctaaagtagcccccctttatttttctatcactttatagcacttatcacaacacgtgatcatcctgtttattatctgactttcttctctacccttaaggggcagggactttcatgacatccacgaatgagccaccagtacctgtcacaacacctagaacagagtagggatgtgatcaatactggatagatggatggatcatggatggatggatggatggatggatggagagatggatggatggatgaatatactggataaacagatggatcatggatggatggatgaatggatgggtggatggatggatgaatacactggataaatggatggatcatggatggatgaatggattgatggatggatggatagatggatggatggatgaatatactggatagatggatggatggatggatggatggatggatggatggatggatggatggatggatggatggatgaatatactggatagatggatggatcatggatggatggatggatggatggatggatggatggacggacgaatagacagggtataatttttgccacagatgcacttctccctttgccaaatgacatcaaaccccatagatgttgtggatggcagggagatacagcattgtgttccctggaaaaacacataaaaactcaatgaagaaaataaatatggtcagtactccaaccacctagagataggcaccatcaacattcttggatacatctttccagccttttctctagtaacctatgtgtgtacaaacatatacactatatacaacagtaggatcaaattgatatactcttttgagacctgtgattttcacttctcaatatattataaatatttccctgtctggttaaatattctacatcctaatttttaaaggtgacttagtatcatatcatttggatacattctttattactaaaacttgtttcattgcaaattttttttgatacctgaaacttcaaagaacatgattgttataaatattacacatttctatctactttcttaaaatcctaaaagagaaattgctgggtcacagagtataaagaatttaaggttattcgtgaatcggcaaattgtcctctgacgattgcattaccttaccttcccactggcaaaaagaccgctgccagtttcccccactctcatccccattaaactttgtttgtttaaatcatagggcacttattataattcttactcaagaaaacatacccacttttggccgagtgcagtggctcacgcctgtaatcccagcactttgggaggctgaggtgggcagatcatgaggtcaggagatcgagaccatcctggctaacacagtgaaaccccatctctactaaaaatacaaaaaattagccgggcgtggtggtgagcacctgtagtcccagctactcaggaagctgaggcaggagaatggcttgaacccgggaggcagagcttgcagtgaaccgagatcttgccactgcactccagcctgggcaacagagcaagactcagtctcaaaaaaaaaagaaaaaagaaaacatacccacttttgcctactgcaatagccagaacattgagcagcactattgaaatgatattcataggtaaagctatactgtcaatgcgttctgaggctcagttgcttcagccatcccatacaatgaagaggaagagcatggaagaaccccaaagaagagttttggggattcagatgaagtccctgaattcaatggagccaggacctactgacatgtacttcctggtgtccagcatcagtaagttctgaaatccagtctcacctgagtacaatacccagcactccatttcctgtgtgagctaaacagagttcttcttgcccttttagaaagcaaccagccaaggaggttcctcttttcctccagctaaacctaaacctctggtgccaaattcacactaaaacacaaactgtctcaggacatcacaaagtcagatgccatgaaaagagctggttatctctttcaccgtggggaagtggtcttgtttagtttcatattttataagaaaagaggcggggcacggtggctcatgcctataatcctagcactttgggagaccaagtcgggtggattgcttgagctcaggagtttgagaccagcttggccaacatgatgaaaccctgtctttactaaaaatacaaaaattagctgggcgtggtggtatatacctgcaatcccagctactggggaggctgaggcatgagagtaccttgaacctgggaggcagaggttgcaatgaaccgagatcatgccattgcactccagccttggcgacagaacaagactctgtctcaaaaaaaaaaaaaaaaaaagaaaagaaaaagaaaagagaccttcattagataatcaaaggtagccactctatctacgtaagacataaagaagtttacatgacaatgttcagtcatgagacactgccctgtataggaaaggaactccttgctgaaatgaaagcaatccagaattactagcatggtcacacttcttttttatttgtttagaaaaggggggttaacttggaaagttgtggtgtttatttgtcagcctcttttttaagttaaaaaaatgcttatacgcttatggcttctaaatcctagatctacagtaattccgcctatgcaaccctccttcttttgaataaacattgtacaatctgctggatttctctatggctttttttcatacttgtgaatctgtttggaaagaaaagaaaaaggaaagcggggaaaaagccttctgtttttcataacgtctaatctttttccccattggcattcaccagatgttgctttggatcggaagataaatattaaaatctaagcaagaacaaagcgagctgtttactgggcagatttttcagatgttctcttaaacagttgaaaaagacaggagatgctttgatatgcaggctggctggaatccacaatggaatggcccctccaagagagttgtagcccttaccacggctgccaggccacatccacccagcctacactctctgatggctccatcggtccattggccaagcatttgtggggaagttcagggagggagaaggtaaagttacctgataaagaggcccgagaatgatggaaacattgactctgcccaatgatctggcacaaagaggcattgggaactttcctcgcaaatgtagaggtaaggccacgattcaagcagttgctctgtcgccatggcaactgtcaaatcacactgcacataggtgtgtctggcagcctcacagctgtcctcctcacgcttcaggccacacaggaaggccaaggacactgcaggaaacagtcaccattaggaaagaaccacagagagaacctaaggcctctagtcggtttcacaaatgaagttcctgtgtcctcctttgaccaataggaatatgaagttagcagtttactttttttaaaatgtattgtatatgtgtaatgtacacagaaaaatacaagtatcatttttgtaaaatatgaataatcatcataaaaaaaactcaagtgaatttcccagccaacataagatataaaacacttataatacacttaaatctgtgtgtttctccccaagttcgtccctttcctcctcattctcagaaataaccacttggcattttttaaatagttttatcacaaacatttgtattcctaaacaagagattgagttttccttgtttttgaactttataaaatatgatacatgataaaatattcttgggtctgattttttcattccatattatattttcaagatttatccacattactacatataactattgttaatacattttcactgctgttcaatattgtattgcatgaaactaccacaataaatttatctattctcttatcaatgaactttttggtatttcctagcttttgctactaaaaacgtacaaaatttcatctagggtgcatgcctatcaagaaaatttcttattcaaagagtaggtacaagttcagctttacaagatagtgccatattgttttccaaagtagttgtgccattttgtattcctaccagccatatttgtaagttcccattactccatataattacaagcacttgaaattatcagacttttaatttttgccaatcaggtgtgtaaaatggcatttcactgtcgtcttaatctgcatttcaatcattacttttaggttgaccaattattattattattattattttttgagacagagtttcgctgtgttgcccaggcttgtggcacaatttcacctcactgcaacttccgcctcccgggttcaagcaattcccctgcctcagcctcctgagtagctgggactacaggtgcacaccaccacaccccggatgatcttttgtattttagcagagagagggtttcaccatgttgcccaggctgatcttgaattcctgagctctggcaatccacctgcctcagcctcaaaaagtgctaggattacaggcatgagccaccgtgcctggccaagttgaccaacttttttatgtttggtaacaactcatgttttctcttctgtgaaattcctgtttctctcatttgcccatttttctattgggttgtttgtcttattgacttggataagtttatgaatttcttgattttcacataattataaacattagcatgttatagagataaaaagcaagtatttgaagcatgctgactctcaggccatttttttctgagtcatgacccacatataaaaagcatcatgaggcagactgggaatgatctttaactagaagatgaacaaagctccacatgagatggtttaggagcagctctgtctgaaaaccttaataaagagggaaaatttaaaaaaatctctgtagcctgcttcctctgcagcaagcctgcccatgtgggtaatgcaacagaggttatcaagggccgtgggcttagacctgtgcttccccgcctcattacagtgctgtggcaagggttacatgagataagtacgtgggggagggtttgtagttatgcaatcatgcccaaatagtactattgttgctgttatattctaaagcacctggcacctaggaggttggctgtgaatgtgttttgaatgaattagagcaataaaaatgactgacagtaggactcttgtatgaacagacaaaacataagaactttccagttagtaagccctaaggcaaataaaaacaagctccacacctataaaataatgaattcattaaaggtgattaagtagatgcaaattgacaagcaggattatgaaaatcacccagggctggggatcaaaatctatgggttttactcaaagttctgccactaaatagctgcgtgaccttaatcactttagctttccatgccttatggaaaagttaaagtttccatgaaaatgtcatgtggtataattcaaggtataaatgcaagaaagccaaagatcaaagattttgctcattttaaacaaacacaaagtattagtttcacctaacaggatgttttggcaactcattacaagaaaaaggaaatttctcctatggttagaagtacagtttgtggggatggtaaaaatgggtgacctccaaaatagcaaaagcacatttgtagagccccctgctttaactccccctgccccacacatgtaaagaaaacatattagttctgtggcacaggcataaacaaaacaataattaagaacgtttgagttcagggtcattatctgtaacctggaatgtgaaacatcactctatggtacaaagtcaaactgaagaaaaaaactcaaagcacgggtcagaattcaaagcgaccttggtaaatgagagaagttaacagaaataaacaaaagaacaaatgaaaagagtaagacagtaaactacaaaagaaaaaaagaaatcatataaatatgaggaaagtccagctgtgcacagccatggtagaaatgcgtgcgtgcacacacacaccccttgggataacagtaggtaacagaaagcttattaaccagcaagactgcagtataattgtacaaacaaacatgggatcagacgatacacaggcatcttacgatgctacccaatttggccagaacttgcttgtatagaacagcttcctcatttggggcttcaaattaggaaagaatataggatttcagagagggctgaaaagtgagatactaaaatgtttacttggaaagtttctgattcagtagggcccaagaattcacatttctaacaagctcccgggtgaggcccttgcagctactgctctgggaagcacacttccagaactgctgccatagaggaactaagaatactccactttccaaagaaccacccgctgattaaggttgaaaaaattagagtaggggagcatccattaggcagaggatggatttctctgaaaagagcaactgcgaaacacttgtaagggttgctgctgggaaattctcccctgaaaaatctttaaaaatacaagtgatttttagctaacttggttgtactcaatcctgtctgaaaatggagaaattagtagtagtttctagtaatgtctaagacctatcccctttgacatttgatgtccattatagacctacttcctagggaaaaaaaaaaaatacacagtcatacactcaaaatgcttcatccagtttcagcgggttaacagaatccccaaatcccatcttggatcttaagtaagaaacctctggagttggctctcacaatttcctctcaatctttagacattgtgattgaaagtcttttaaaagacttttttatgaaaggaaaattagttaaattatgcattcctctagagtaaatgtgtgccttgcacaatcaatgagtgtttggtgacacctagtggccatataaatagttacagtttccaactaattttcctctttaaaaaatcatggaatgttgagttcttttctaaatctttctaaacacaataattattttattattcttccccaagaagttataaaacttaaaatatcacaacttacctgatcctgaaacatcattgatttttatcttatactagttgaaattaagtgttttgaaataataacacggggcttttaaaagtatattaatttgagcagtgtatatatgaaagcttttttaaaaaatgtagcagtattagttaaaaattagagcctataaatgtgcagtcttagctttctgtttatgctatctctcatttattcctcaccaagcactaattttgcacataccctctgcaacactgttcctagcagaggaggtagagcagtgaatcagacaatgttttgaacttcaatcttctattgtatcttaaatttcccattgtggactctatctctcttccataatgtgtttatatacatgatgataataggaaactcaatttctagcattttaacaaaaatttttttctcctccccttcttcttcctcttccctcttccccctcctccttcccctccttctcctctttgtataagacaacacagcacaaatttccatcacaatagcattatccatcattaaattctcatccaagctcagatgatgtggtgcttttatcattttgtaaatctttagcccacattcaagttgcagacaaataaattaggaataaaacttaaacactacacagaaaggaggtatgtaaacggttaagtgcacaggtacaagatttatgattaggcaaataaggtaatcacctggctaaatgtgagctatctcaaatgtagtaaggtcctgtagtaataacagtaatttcttccttttgactttatttcctgaagctcagtggggtattaccatgtgttgtgaatccccaagctttgcaacttactctctcatctctttccccacaaagacacggcttctcataccacaatttatatgatcactacgcagcttaaagtagtgagcaattgtggtgttttactgaataagaaataagtaattatgtgagtattgcaaaacaagaagacaacatgagtgttggctcttttgcctataataagaaaccgaaaactgaacacacaaagctaattttcaagtgatatccagcttgaaaatctccatccctttactggtacctccaataagcagatgtcttcagcaacctcacctcagaacaaagccaagagcttgtttcctccatgactcctatagctgtcattgaaactaatattcagaattcagaattacttcctctgtcatcctaagactgcagttaagaacacaggtgataagtgtttcaatattcatctaacattgacatattaatatgacaaaagttatgatgaatcattttaacaggtggcctcagattctaactatcattttagatgaggagtagagaaattcttttcctaggcacacatagagaaattagtagtcagtacagcattaatcacaaaaatagaattaaccaaagaatatcatttccatatatatgctttaaaatatatgtgtgtggcatctttactcaccatccaggggcagaaccaagcagctgaaggcagacactgtagcattagccaggactcggcagggagcaccacacacagcagctgagacattccctggagaaaatcccgctccaaacacatgcaccagccttccacccaggcagcctttaaagacaaaggtacaagttcttgatcatacaggcaaatctcccttctttactcaactcaaaattcaaacatttgcttcctcactacccattcttcttttcacatcctcagaatccgcacaactggcttgaggtggctgctggcctcagtttcctctccacttaggctctggccttgtctgactccaatcacattcaatatcctattgtgttaaagaggtttttttttaatgtaacaatttttatatggaaaattaatgcttatttatagtttttaaactttttattcaaagagccataaaatgaaaataaaaattcccccaaccatctgactccctccccggaggtacccaggtatagagtttcttatggctccttccagaatttttaagcatctatgtttctgattcaaagcattattctatccatattattctggaacttgcttttttgcttcaaagtatagcatagatgttttttcaaaactctatggatccagttcattttagtagctacttagaattccattatagggccctgctacaatttatttgacaattttcctatttattgaaatttccattttttctcctcttttgctattgttaatagtgatgcaataactgtacatgttttgggacatttgtatgagtaaaaccagtccacatttctagtttacactgagatacagagttcccctcactactgccttcataccaggtctaggtggtacttagccacttgactaactcaaaaataatgcttttggtttaagatgcatttcttatttccctgctcttccatcataaaaaaacatggaatcttagggagtagtgcctttatcaaataaggaagctgagtctcagaaaagtcaagcataaattagcaaaattagtgatagactagagccaaatcctagtccccacagtgttccaccaagctgagaccaaattttttctaagaaatgtcttagttagtactccaacagtctaagattctgtttctatagtttttttccttactttctaaatcacaaccaaatttgaactatctcaagtgcaacaaggctttaagtgaatagaaattgaaagcttttcttcactggagggaaaggctaggcaatttttggtatatctaaacggagaaaacagtccaaccaatttaattgttctgtgcatttggcttattattgttgaaatatgagtccacctgtgaaatattacaaaatgataaaaatttaatcatacttaataaattttaaacaacgcaaattggcagatagggtctaaaactaggtgaaggcatttacgttcttaaatgatcaaattatgagctcttacaaatggtgttatttaatttaaaatacaaatccagttaatgcatcaaattaaaatacaatcaaacatttagagaatatgcacagtttccttgataaaaataaaaaaaatcttcataaacagagcataacaaagacaagcctcaggaaggaattgggattgtaagaagccagtgggcttctctttccttccatcaggcagattgtgttaattttctactttccagaagtgaaaggagctaccaattcatttacataaagaaagtgtgctgtcttatttgcttgacttaccgaagttctccgtcactgctgtaataataactcttgaggtgaacaccagggcagatgaggcccaccctctgatgcagtcatagcctctgacgtggtactccccggccggaagggaagggaccacgcactgaagaacggtgtggttaccagagacacccacacagggtgacattcctataaaaatgtcaatgtttgcagctcctgagatctgggccactgcaaaggttaagatgtcatcgctctgagaaatagagatcaattctggggtaaaggccttgttataaccaatgactcctatgtgataccaaagtccatctacctctatttccagggcaacagagccattccctgtgggaacaatgcaccggatgagctcagcaccgatgttcaccgtcaggcaggtctgctggtcaatatagactgacgtggtgttctgtcctctcaggcctgtgccctctatggtcaagaggcttccaccatgtaagctgaaattcttaggaaaataatgaaacacttggggcataatgtagaagtgtctggaaacattaccagaacaagcatacccatttcttgtataaaaaactgacaggtagtggggtcctggggccaagtctcttgtctggcacacaacgtggcttgcattaaaaaaagttacattgcaaggaagttgatcatccacaaataccatcggctcatcagctgtggtggctaacctctgacccctaatcagcacagtggtcagagacccactggtgtttgtggacaaggcatccatgacaggacttgcctcttcccttatgaaaagagtgcaattcccctgacactcgctggttagcccattgaccaggactgtgacgttcagggagaaggaagctccaggcaaggggtcaccctccaggctaacctggcagagaatggtgtggtctcccaaactcaaaatcacacaagtaaaaggacccgagaggtcaacccgaactgacctccttctagagttaagaagcaaccccctcacagtaagtatggtcccaccacatgccgaaccctgcgatgggaagatggccattatccgaggcatcactgcaaattgctggagcaccacagacatattagcaaatcccatctgcttctgacgtacttggagaggatagatgccagcctccagactgtgaagagggatggagcatccagacaggctcacgttgccctggaaggactgtgtctcaacatcacagttcaggttccccagaaggatgactgagttggagaggttacttcctcccacatgcaggctcaggctgctatttgtgatttctccttgcatggcagtgactactggtgttgctgccgcttcatacatgaaggtgaagcctttccccaccaagcttggtgaaggaccacgggcgaagaacctgttgccagcccagacctccacggcagctggaacagtgggagcgcccgcatcgggtatctggggggctggcagggtttcacaccagatgctcgcctccgttaagttcacaatgtcacaggaccgattgcccacaagtacccaaaccaaagctgggtccctgctgaagcctattcctgagatgctgaggatggtccctcctaaagtatgaatacggaaagcaaaatattatagctgatattctgaactaagaattcatagcacctgtggaagtcctaggtcaattaagtggaaggtagggcatgtgttagtgaaacctcaattattttttctcacccccaccaaagctaaatttgtgattatttagacaggagtcagatgtggtaaattcacataacagtaaaataatacaaattgttatataggaaggacgtcttcaacacaaacttttcaagtacctttgtatatcccagaagccaccactttaatcaacttacacactaatgaaaaatcaaatttcttagtcttcttatcatgtattatattattggaaatattatcctgtatgctatatatagactatttgtacattgtcctgtatacattcaacttatatgctaatgaaaaatcaaattcattgaagtcttctatcatttatattgttctatataatattccaatattccatatattatacattctaatatattctatttattgtaccatatattctatattccatatacgtgagagacattaaaagtcattgaatcttgctggtgaatttgctgctaccttcatagaatctttgccttactctccagtagagaggccaccaaagatcaaaccccatcttcaggacaggattggagcaacatgacccacagcataaccaaactgtacaacgtggcttttaagaggattttactatacccaaaaaggataatgtgctatcttacacatgatcacaactattattgacatgccactagattgttttccattctttctgaaaatagttttagagattggtctatttgtcttgttcttccatctcccatatcagcatgtgtgtttctatttctgagtctttcatctgtctctctcatggaaagtgaagacccgcagattcaatcctcccctccttgcatgcacagcatctaaatggcgaatgcaggacatgttgcccttgtttttctcatatccactctagagtgtcacccatcagacgtttcatcctcttttcattagaaaagcaggcacatctcggctgggcacggtggctcatgcctgtaatcccagcactttaggaggccgaggtgggcagatcacctgaggtaaggagttcaagaccagcctggccaacatggtgaaaccccatctctactaaaaatagaaaaattagccaggcatgatggagggcacctgtaattccagctacttaggagactgaggctggataattacttgaacccgggaggcagacattgcagtgagccaagtcagcaccattgcactccagactgggcaacaagagcgaaactccgtctcaaaaaaaaaaaaaaaaagaagaagaagaagaaggagaagaagaaaaagaaaaaaaaaagaaaagaaaagcaggcacatctccttgtcataaaaattccttaatttcctgagcaaatgaatcaccaagttttaacacccttttaaaaacacccctcagttcctggagcccgaggaaagtttctctcctgtttcccctctctctgacctcactggcaaattaatccagaaacaaaatctgaatatccagcaaatagaattgctggataattgataacagtcacataagagccactcacccagcagggacccacagcaaggctcgatgctgaaaacttctgtgaggtactggatgtggagatcaaccctacagaagataggcagatgtttaggaaataactgacagagagagataagaaagagtaagccagaagagccatatgtattttgaggagaagagcaaactgtctgtaagttctctaagatttgttccaatgttatgatgttcatgtctttaacctctaacttccaagggaaaaagaaaatacctaactcaaaattagaattacctagctgaatgctagaccatcaaacaaatccaaaattaatgcaagtggtcacctcacccttgtgagtgaatgctgaccccattgatagagacggaaattctgtggagaccagctggcagtgggggcagtgccacctccaggccccaagccgactgtgtgtgaaccggagccaaggcatcctggacgtggacttccacatccaaatccgtatagttcatcagcctcgccactccaatgaccagggtctcaccgcctgtgttgagaagaatccaatagcctctgacatgtggggtttgtgggctcaaccatctattcaattctaaaactgtctttttggattaaattcacagtcacccctatgcataatactcttaagagttacgataccaacctaaatttttcaagaaacttctaacaactatttttttttttttttgagacaggtctcattctgtcacccaggagtgctgtggtgcaatcttgtctcactgcagcctcaacctccagggctcaagcaatcctcccaactcagcctcccaagcagctgggattacaggcatgtgccaccacacccagctaatttttgtattttttgcagagacagggttttgacatgttgcccaagctggtctcaacctcttgggctcaaccaatctgcctgccttggcctcccacagggctgggattacaggggtaagccaccttgcctggcttaacaactcttttaacagagatatggtctgtaacctcaatagtataaaaagaaaaattggcaggacaattgtattcaagagacactaacttatttccatgcaaaggcaaatcaagaagtttgcagagctaacggtctttataaccagcaaagagcaccacatattggttgcttaacctccacttttctactggtagaagtctgaagctatatttgagtgtgcactgaaccttacagtaatgctgtatgtgagtttagtagctcataactgacagagtactttcacgtatgttatcccacttggtccacacactatcctgatgatttatatggggcaattaatatgactggtattttgcatttgaggaaactaagctcagcagccacagcctcatagctattaataattactaaaaaagaaaaaaaaaggtcaagacctgagcccagtcttttgtcttgcatttcagtgtccttttagtttaattagcaactctattaaaatgtgtacactatgaacactttcatgcaatttcttttaactcaaatatttattgagtaccataaggaagatgctgcaaggggcacaaaataagttaaacacagactctgccctcaaagaagcctcaacggtagtaaaataggtgacaaaattgcttcaataaaagatatactacaagagaggtggaaattaagcactgggattgctcaaatcagagcaacattatgaatatcaggaaagatggaatgggcaagatgagagttgaattggagcttgaaagataaatccaaaaagaaagtcatagagaaaagggggcttatcatttatttctagaaatttcacggttttatccaaagcctttcatagcaatttctcacttaatcacccagtggcttggagaggaaaaagagaattgggtgatgttctggaaggcacaggtagggttctgttttggggataagccaagttgatggtagtcctagggccaaagaccaagaaagccaagccagagggatgtctgcttaactcagtggacggcagtgaccgccaaagacttgtaagcaaggaaaagatatgattaaaactgttcttccagtctttaagataaattgaaaagataggggaggagaaatccaatctgcagacaattgtagtcttaatcaagtagaccaaatcaagtgggcaacagcaggagtggaaataaatgtccttacctttcctgtgtcccagtgtggccactgaaacatggcttgggctaaagcatctctagctcctttagcctgtaacatttgaggactactgcagagctggtatctatgggatgccacggccaattagatgaagaggaaaaagaggttgcttgaaagagaaaagtcaaagaagagggatgtggtgtggtgggaagactatgaatctgcattcaaatccttgatctgccattttactacctctgtgactttgggtgatttacttacggctctcaaagccttggatttttcatcaataacatggttaataaagcccatcccatgtggtttgttagatatcctgggaaagtatctggcatgatatagcacacaaaaaggccttaattaacttcattttcttcctcgttccccattctcttgaccgcatgtcttcccaatctctactgggaagtctgaagcttcagtgtagtgagttcaagggatttcagggctgatcaaagaaaaagacatgactacgaggtgacagtagcaaaaaacaagcattatttgggtggtattttgacagattcacagaggaggaggaagtctcccagcatgagaccttccagaggcaacagtattgggccaccatccagaaagggaagaaggcaagggaactgggagggggtgggaagatgagagaggggggttctgtgtccagatgatgtcactcagcagcctggtgggtagcctctgggacagagagctccaaaggcatcagcggcttagggtattttatagccccagggttttcttacctacagctgactgatgggtgcagtttcatggggcatgcaaagcaagaggaatttaaatggctaaaaatatgcttattttggctacgctgaaaacaagtggatgtgtaaaagtttgaatttagcactggcaggcttttgagctaatggatcctggggtgccatgaagaagtaaaaaaaaaataggaccaataggcagggcctttctttggcttgtttataaagcattcaatatctggcagaatgatggcattcacttcaacaaagatttattggtgcttactctatgtcaattcctggaccaggtactttcatctgctttatttcctattttcatgattaccttgaaagaattattcccacctatcaaatgaaggaactgaagataaaagaagttaaatatcttacccaaggagtatggtaagttcaactaagtttggcctaaggctgtctctgtaccttgagtctctacataaagaactgcaacccaactttgtgataaactgaaagcctcaactacctgagcctcagttaatcacaggctgccaactgatcagaccatgctccaataaggcaaacagggagctgtttctggcctcacttccattttctgtctataaatgctgcctgcccatgtggcatagtggagctctctgaaccttttctggttctacaagttactatgattctttgttcaaacaaactctgttaaatttaatttcttgaaagttcttctttttaacaagtggttgagctgggattcatgcagattccatttttcctgactgcagaaaccaacactaatggtcctgcacatcaaattcaccagcactccccatccttggtccctcttatgcttttattttcatttcatctcagcctcacggtcatcatcaacatcatctcttggatggagatgtgcagcactccaacttaaaagaggcattcccaaaaggctacgacacttcgtggattttataacatgctcctttttattctgcttgtagaaagatttaaatacaagtataaattttgaaaagaatgcattgcattgtatgtatcaacaacataacttttggagcacttggtcaactgtcaagctaatcctagatgcttccttggcactgatataatgtatttattcttttcattacagataagaaattttattaaaagccaaaatcactgaaatctgaatataacatggagctccccctcccttttctacctcatcaggaagaatctgtaccactaaggaattttacacacttcagtcacctggggcagcaaattcttcttctgcattatctgagctgaataatattggaagctaaaggacacttctctttatttatgtactcttgagctatggaaaatgaaaatagtgccagaaaaattgagttcagactttttctttgggaaatatgatggtctttttacaataaacccttagatatggctaccacaaaccctgttatctggcattcagttcaccagaaagggaagttacctgctactcttccaaatctatatggaattacatgataataaattattataattctaccttgccatatcctctgaatcatcaaagaaaaattctttcatgtagttggtgctaatgaatccattatttttatacgtagaatgtctcaagaaacaagaattctaagttaatcagagcatcctattctctaatcatattaaataactgctacaatagaacctgctgtcaaaaagcagtattttacagttaactacaagtagataagtacttggtatatacaaacagatgacctgtgttcaaatcttagataaattacttattctctccattccttaatttcctgatctgtaaattgaagctaataatcctataaattaggggcaaggattaaattacatctattttatgtttatgctatcattattgacacttactaaatgctcaaggaacatattttgaattgtaacttttgaattcccacatccttttcatgatggaaatggtcccatctgtacaatggttccattttacagatggaaaagtagatatcaggagattgattcgatgatggctaagatgaaaaaagcaatctcctagctttcaagaaaaaacttaaatccaaaatacaataaatttcagaggacattgattgccctttttataggaccaatgctctaagaagaaaaagatcttgcagtatcacatattttacctgctatattgcttatgtttctgctcagagtcacaataactggatttaaggaagagacatatgtaaatgctctgggaagaactgcagaatagtcccctctgatcacagtcacattcacaatgcgtccatctttcccctgaaaaatcaattttaaaaattaaacctcagttttattttaaagtaggactgacttaagggaagagaactccatatagaattagttttaaaagttaattttaagaaagttgttcctaaagggtatatttcctacttccaagtctctctcttctctacaaccctgcacactctccccatcctgcccccacacccacaacacagagtgataagtgcttggactagtaggcaagtgcagtgttagatgcataatgacatgctgtaaggggtaaataagaattatttgcaattaacacaccaattgtttctgcaaaaatatggcaatttcaaataaatgtctatacctagctaaactatccatcaagtatgagagtactttcagacatgtgagaactcagaaaatttctctatgacacactctttcataggatgtacttatggttattatctcataaaataaataataatttaaatatatatatatatctgaaacccaagaaacagtgactactcaagaaagcaatcaaagtaagtactaggataaaatctgtagaataaacctagaaaataagcaggctagattgaaacaggagaacagagatagcttcaaggaaaatgaatgactgatacgatggaactttttttaaaagatattggatttaacttataagaaagacatgttagccaggcacagtggctcacacctgtaatcccagcattttgggaggccgaggcgggtggatcacctgagatcaggaatttgagaccaacctgaccaacatggagaaaccccacctctactaaaatacaaaaaattagctgggcatggtggtgcatgcctgtaattcaagctactcaggaagctgaggcaggagaatcacttgaacccgggaggtggaggttgcagtgagccgtgattgtaccactccagcctgggcaacaaaagcgaaactctgtctcaaacaaacgaacaaacaaaagacatgtttagaaaataaaataggaactctaggggaaaaaaaaaaaaaagaactataaaagaaaaaaatatactacccggttctgccagcatcatctaaatagttagaataatataaacaggttttattaatttaagataaaaatggtattgtaactatatttgaaagaattaaaagttgtttcaggaagggggacttgaagaagggggaggaggggcaggaaaacataatttactattttccttttaacctatgcatctatcacttggatcaaaagtaaaatttattttttattaatgtttatgttctctggtaaaagaaattaagaggtacatgtcttacccattaaaatggcaaatatatattaaaataataaagtgataacccagtattggccaaagtgtcaaaaatcacacacgtgcacaatgatggtgggagtataatttgaaagggaatttcagacaactggatactacatatcaaaagctttagaatttatattaatttatcctgagaaaagaaatgtacccccaaaacatagttattaggatgattaaagccctgttgtttacaataagaaacatttagaaattatctaagtgtctggtaataaggaatagttaaacaaattagagtacaaccacatattggaattgaatgtagtgtacatataaaagctagcttttcataatatttaaggaactagatgagattaaaatgtaggactagtgatcaaagaatattttgaaacttatctcccaggggatctttattttggggtcatgggtgtgctaggaatgttgatgctgcttaagtcaactctaaatagaaagttcagtggcagcagtgcgtgtgactctccccaacagtaccagggaaggacccagactcaaatcccttaataggccatgatatagcactaattgaaaggaaaggaagaggtcagggacttgtttttaaggggaaaaggaagcaatggagaataactaagaagatatttcttagaaatcacacactctagaagtttctaagttctacaattaatacccatactagaaaacaaaattgctgatgaaaactaagttatttgttgtttgcttaatagagaagggagactttgaaatatataagccttgcaagccaacacccagaatgtgcactagctaaatttatttgttacgtgtcactaatacttactgacagtacagaccagaactgcctggttgtcttctttttaagaaattaattgatgttaattacaagctccattggtggggtcagtttcccacttcatagcaaaacagacaatataactactacaagcatactatcataatgagaagtttacatcagttcatttagttctaagaagtgattcactgaaaatgttatattaacagtggtcactcacccagagagaaagagatatgaaaggaatccacttaccctgggtggaactttgcactgaattctgcttgaattgcttgtagcgacattgatggcacacgagtaagatccaaataatatcaggctaacaccttccaaactagagcctcggatggtggcccagagccctcctgtaacaaaaacagcatattcaaatgggatcaccaaccatacaggcagacaaaaattaattatgcacaagatggataaaatgaaattaaaatatgaaactccttagtcaaaacaaaggcaatgctcaaactgcaggaaaaaaactggagttaaatatataaactatcatatagaaagggagaagtagtgacaggagggcagagagaggtagcactgcatcctgaagtcttttaagaataaaacctaggaacacaatcgtgccacaagtctgaagaggtagtctctgaaaactcttcctggcctagattttgaatatcattcctgcaatcctataaaacatattcttttcctaagaaaccaagtgcaacagagcatcatggtggaaggaacagtggctgagagtcagggtcagggccacagattgctcagctacttttagcaggtcattgcagtatggtccctgagctgaagggtcaacattttcctcatctttaaataataatgttagcccttccagctttgtggtttgacactacacatactaggttcagttcactgtgaaaatatagaaatgagtggcatcactgcccatcgccatcagaatttctctactgatcactaaagagcaaccacagaaatccccatttcttccctgcagatgttagcaagaagagagttggctccagttctgctatcatggcacacgtttccatgtggaggagcagcctttgatctagctaatgtataatgattctggtctgccatctcccagatacaagagaggcagtgaggccaccaaacagccttacccccccttgagggtggggagggatgcagaagcaagactactttcaagcatgttggggacagaaaggggaatctacaaaatctgatgaaaacctttgaggacagtgtgactcggtggactagtaccctgaagttaagtgcataactaagagcaatatacaatcgtgatataaaatatacaatatctggaagcaaacttcaaaacaaaaattaagaagataaaaaaattgaaaaaatatttgaaatactcttgaagaacttaatggatggattaaaacttacataagaaaactaaaataaatggatcgaaagagtgaacaccataaaggtgacatatctttataaattaaagcataaatgcaatttcaatagacatataaacagaatttgtacttaaattagacaagctgattcttaagtttaatgaaaaataaacaagaatagccagaaaacaaaatttcaaaaagaagtgtaaagaggtcttctgccatatcttatacagtaactatggtatcaactatgtggtaaaataaaatatagtccagaagaaatgcagatcagtatgaggctatagattaggatataagtgacatttcacataagtgcaaaataaattattcagtaaataaaataagtaaatatcactgaaaaaaaactaaatttgaatttctaccttatatgcttcaccaaaataaattcccaatttatcaaatatttaaatattaaaaagaaagttttttgactagaaggaaacatggcagaatttttattttcatataatttcagagttgcaaagtctatcctaagtattttagaagtcctgaagccataaaaggaagatatattttattatgtaaaaattaaaaatatttacgaatttccaaaataaaaaacaaagagacaaatgataataaagggcaaatatccttaatacataaaatgctctttaaaatcagtaagaaagaacaataaccccattagaaaaaatgggctaaggagataaacagacatttcactgaaaaggaaacacaatgcccctaaacacatgaaaagatattcaatttctctctcaataaaataaacacaaattaaaaccacaatgaaatattcttcttctcctataaaataggtaagtgtcaaaagggttgggaacacaccgtgttagtaaaatgtggtaaataaacactcatatatgcattgttgcttaggcaataaattatgcaacctctaaagagaatcttttgatatttatcaaaatttttaatgcaaataacctcttgacccagcaattcaacttctaggaaattatgctactaatatttttgcacatgtacaaaatgggacaactccatatacaaaataacaaagttggaccctgtttagggctgaattatgtctcccacatccccaccaaaatttaggttattaccctagatcccaataactccaaatgtgaccttattcagaaatgggatcttagcagatgtaattaaactaagatgaggtcacactaaaaaaaagataagccctaatccaatatgactggtgtctttataaaaaggggaatttgggccaggcgcagtggctcacgcctgtaatctcaacactttgggaggccgaggcaggcagatcacaaggtcaggagttcgagaccagcctggccagcatggtgaaaccctgtctctactaaaattacaaaaaattagctgggcatggtggcttgtacctgtagtcccagctactcaggaggcaggagaattgcttgaatctggcaggcaaaggttgcagtgagctgagatcgcaccactgcactccagcctgggcaacagaatgagactcggtctcaaaaaaaaaaaaaaaagttggcaggggtgtgcaagggggaaatttggacacaagcaagacacagggaggataccatatgaaggtgaaggcagagattggggtggtgttctaccagccaaggaacaccaaagattgcctataagacaccagatgttaagagacagacatggaacagagtcttcctcaaagtttggttcagaaggaaccaacactcctgacaccttcatctcagacttctggcccccagaattatgggacaataaatttttgttgtttaaaacactcagtttgtggtacctgattgcagcagccctaacaaactaatacagacccctacctcataccatgtacaaaaattaactcagaatgaatcaggtacctacatctaagagccaaaactataaaaccctcagaggaaaacataggcataaatctttgtaacattggattaggcaatagtttcttagatgtgacaccaaaagcacaagcaataacaataaatataaactggacttcaacaaaattaaaaatttgtgtgcttcaaataacactatttttaaaaagtgaaaaggcaactcacacaatgggagaaaatatttgcaaattatttatctgataagtgattagtacccaaaatactttaagaacttacacctcaacaataaaatgacaaataactcaatttaaaaattggcaagatttgaataagcatttctacaaagatgtataaatggccaataagcacatgaaaagatattcaacatttttagtcattaggaaaatcaaaatcacaatgaggtatcatctcatgcccattaagatggctactgtgaaaaataataataacaagcactggtgagggtgtggagatattgtgatatggtttggctctgcgtcctcacccaaatatatcaaattgtaattcccaatgttggggaaggatcctggtgggagatgattgcatcatgggggcagatttcccccttgctgttcttgtgatagtgagtgaattctcagaaaacctggttgtttaaaagtgcatagcgtacccctctttgctctctctctcctgtcactatgtgaagatgtgcttgcttccccttcaccttctgccatgactgtaagtttcctgaggaatccccagtcaagcctcctgtatagcctgctgaactgtgagtcaattacacctcttttctttataaactttccggtctcaggtagttctttatagcagtgtaagaatggactaacacacattggaaccctcttatattgctagtaggaatgtaaaattatgcagccattttggaaacagtttggcaatccttcaagaagttaaacatggagttaccatatgacccagcaattccatttttaggtatatacccaaaagaactgaaagcatatattcctgcaaatcattgtacacaaatattcatagcagccttattcataataatcaaaaagtggaaacaatccaaatgcacatgatgagatggatggaaaacaaaatatggtatatccataccatgtaatattgtttagtcataaaattgaataaagtactgatacatgttacaacatacatgaaccttaaaaatatcatgccaagtagagaagccagatgtaaaaggtcacatgttgcattattttatttatattagatgtctaaaataggcaaattcacttagacagaaaatatatctgtggttaccagggattgggaagagggagaaacagtgactgactactaatgtatacaggttcctttccatgatgatgaaaatgttgttgaatcaggtggtgatgaggtatacaactttgtgaatatactgaagactgctaagtttatactttttaaaaatgagttttatgatatgggaattatatctcaattttttaagttaaaaaagagatccttggggtaaagaaaagaataaaatatcctacctatttctaaggtatactaccctaggccaagccaacattatctctcccctggatgtctgtcatatcctcctaaccggtcttgctggttccatctttgcctccctactgtgagttctcacacagcagcctaagtcagatcatgtcacttcacttgaaatcctccaatggccaccatctcactcagaataaaagctgagtgagctgagggccattcatatcccccaaggccatataacttgctttgggtcatcttctactgctctcccctcactcaatctactccagccatggcaacctccatgacattctggaacaagccagtctaactttgactcaagactttttgttccttgatgttccttctgacttgaactgtcttccccaagatttccccagaattcattccttcacttcacccatatctcccttctctaaggccactcatgtcattcctccaatgccaatgactataccatcacaaccatctactccatccctcttcatccccttcccttcttgatttttatcctatacacttaccatcactgccccaagaacagaggatttgtttttatttactgtatccccagcattaataatgcctggtaataaaagctaaataaattgtcattatgattattgttgatggtaacaattaaaggttgaagaggtgatgatatcttgccattctcatttgaaagtttagactatggccacacaagagtccgtaccttaaagaagacaatgctatctcagcacaaaaatgaatgaagaaagtatgtaaagcaaagccaagattttcctcaaaaaaatcctttcaagggttttgcttctgcaaatgggtaggtggtgatttatcacattattgtatccattcattacatatgcaaatattctgtaaatttcttgctgataggccccagcctggttctctttaaataccccagagcatcatttctcaaactgtactcttcatagagattgcctgaggacatgttaaaatgcagattaattcagaaggtctggggtggagcctgagactctgcatctctaacaagctcatgggtattacagatactgcttgtccaggaccacactttaaggaccaaggtcttcagcacctcacacagggctaaatgggatgggccaatcagtgttgagtgagtgagtactgattaactcataggtggcagggcaaaggaagaattaatagaaaaagtttaaatccagtaataaggaaagcagcagctagagcctctctctctccctctccctttccccatagtcttaataaaagataatttctacccgcttggcatatcccttctcagagttttccatcttttgctaaaataatgtacaatcctcctagaaatcccttcactgaacagcatgttctgatagggtaaccaactcactccaattttcctaggaccaagttttagcactaagagttctgcattccagttttaaaactgagtcttgtgtcctgggaaccccctcagtcccaagcaaactgggaaagttggccaacctacctgtgcaaagcactttgtctaggggaaacaaaaatgactgagtcacctgtttgccttaaggtggagggagctgaagaaggtatgtgtggcctgaacagcaaaggtaactttgaaagaagatcaaagccccttataactctatagagaaaactacactatgccctacactcaaaccaataattactgggttaatacagaatatgatctttcactctgagctccatatatcatctgaccttccttaaatcatggagaaataagtgcaagttatgcttgctttgttttatgtgcagaaacaaggtggggtgggcctcataattcactcttctaggcaaaatagggtcagaaaaaaatctgttcttttgaacaatgagtttgtggccaaaccacactgcttttaaatatgttctaagctgcagtcctctggactccagaataaaccatgacaaaaatccaaagcattaaggaaaagggctttatgctctaatgtttattcgttaacaaacataagcatcagtattcctgagattcttgcaatctggctgggttgtttttaactggctgtgtccctcagaaagcagaaagtcatggagaaatatttgattttccatagaactaacccaattcataaggctatgttgacaagacccaccaccctctgtattgcccactactcaaatggcaatcagttttccatgctagccaagtatcccagtgtgcatcagttcacaaacttatgaaatatcaaacatgtatgaaagttatgtaggacccaattatgcctgacaccaccagccaaactataatcctttatgtggcaagtgagttcatttaagggctcaaatgtttgttgctcatttaaatacttatgtcagtaaacaaaagacagtgagtcacagtgaatatggaattcattacacagaaggactagattcctatcagcaagaacactagcttcagagggtcagacatactgtgagaccctccccagattaccaatatccgcagctctggaaggctccaccatatccagtctaggtttcacatttaggaagaggtcttctccagtggcactgatggcaagaccagagggtctcaccaacatcaagatccgatgcattccaacaggtagcaaatctgtctgacagactacattggtctggtttgagaaaataactttgcaactcgttttgttcactgtaacctgcaagaactgggagtcaccagagaaaccagttccggtaatgtaaatcattaggttgatgtcaccatcttaaaggagaaaagaaattaaaaaacaaataaaataatctctcagtgatattacttcatttgagagacctctcactatcatcaaatgttccttctctgcccccatcccctcccaaaattcaaggagctgaatgctgaattaaatattggccatctgtatttgttattgtagtacacagccccgatcttaaattttctctaactagtgagaagtgatcactgctcaattttttaaaagaacataatatttcaaaataaaggacaaagacaataaaacatttttagtcatcaaaagtccatctctccccatttcaaatcatgaccatatcccttagatggaccaaaaaatacactttctgctacgtcactcaacctctgcctaatgaactaatttatcttctacccacccatcaccagctacatggcctctaacaaaatcactgcaagtctccggcttaagcccatctcagagccaagtgacaaatcataccaatggagtaccacacagaatggacacagggagttgacccttggaggtactggaaagagcaggaacctgggcaatgagctggtacatcattcactcgcacaaccacctgaaatgaggcaaaatttcttttccattttatgcatttcatatctaccagggtattcataaagtatatgtgaagtgctcccaagctgacacgtgttcatgattcgctaattcttattccttttttctatttttccagtaattaatcttaaattgcaatgaatggctcaaaacacatgaagctttcttaaaatgatggtggacatgctgaaccccatttctgtaattaaatgtgataaatattgagtaaatttatctctgtcatatagaagtaaacttcataaacttaaactgcataaggacttcttatcactctgtatttccaaccaggtacctactttatgtgacaagctctttatttgctagtaaagaccaacaaatttggtgcattccttccaccactctgtgaatatataactaaagactagagtgtatttggacactttacttggggtctcttttgtcacagaatggtagattcctaaagagagactatatatctttccctttcactggaactaatgttaatctaatagaactcaaaaactacttggaaatgagaaaggtaaaaaagatgtgaccccactgattctctatgtataaaaaatgcattaatagcatacagattatattcatgacagtgtttccttattaaaggaagaggtattgcaatggcatggacaataaagaacacttcaattttatctgtactgtttcattttttccataaagacaaaaaatataaatatatcagaatgttgacaatgtcaattttcagtttgggtccccaggtgttgataatattattctttattgtttttgtattttaaaactttatcaaattgaaagtagatgacctataacagaaatatggaaagataggaaaaaaataaaaggactttttaaagacaaaaagaatgacttagctcatttactttttgataccaccaggtagaagcataaatcatatttagctatagaaattatcaattttttgtaccataacaacagtatcaataattataatagaatattgtggttacaaggcatttatattttcagggaactgtacataccctgtggaggtagaaaaaggacagccataagtacccctgttttacacattggcaaaatgacccttaagagctaaatcaatgagtccatgttacaaatcagtgaggagtgagttagacttgaaactggagcttgcacttagggtggcccattcactctcacctgagtatgctggttggcagtagccaacatgtctccaaatatgggtccaagaaaaactccaccatcatataccacacgcgtggctgcagcaggattcactccagtaaggttttcatcagagacctgagatggttacatttctggtaaattctgtcatggaaccgaaatctaatctcgtctaatcaaataataaagagttttttcacattgtgtttcagataatcagacagctagaaagtgaaagcagagtaacagagaattgaaatatagaaacgtaacagtaaataatggctgaggaaagtcccagtagattagagaaatattcatttgcaagtggattgccaaaagaggtacaataaatcaatcttctctctaagtcttgagacactttgcttctccatgcttttccattttatatgtttgcaatccaaaatattaaaataaagtggaaagaaacagtgccatgagataagagcaaggtctcccattcttcctccatctcctttctagaatttcgattgaaaaccagataacccacaacaccatacaactaggaaaaattttcatcttgggcttcattttataataaccaaatgctagttgatcattagattattttttaagaccctaaatatgcaagagcatctggttttgtcattacccaaagacagcaaattcttttctaaaattccttctgctatgccatctgcttccacaatcatctaagtcaatcacatctgcttaaattatccaataacagatgtagaattattgcatggtggacactgaccaataacttcactacctacactgagttaggaagggagatgttgggtttaaattgctttttcagggatatgatatacaaaatatgtgttgaaaacttccagaaagaaagttcatagaatccctttactcaaatattccaacaaaattaataattcatgacagtttccatttgtataattctgatttttttttttgcagaatttctccagggcagcaaatccatgccactagaagggatactatacataccctgataaaattgggcaaatccccaatctgagtggaccaggacaaggtccacacgtgttcgtagcaagtgtatagatcctccttcacagtgaagtcactggcattgaggtacctggatgtgaagtcatcggcattattctgtaagagctggtgaaggtgatgagcagaaatttgtacagggacatctgtgagagaaggttttgatacagaaaacacagacactaattaatccaccttacagagtttcatcctcaaggataacacgatacatactaggatgcctatcaaattttcaggagacccttctgtcaaagtagaacttcagtagaatccccagccataattaaaccattttttcctaaggtaaagacaagtagatgcccactttttatattacactatctttcactcataccatatcacacagcaatcagagagcacagccatgtcagataaaaccatctcaactgtcaactcaaaatgtaaactccacacacccttgtaatgcctgaaagcataattaaatattagatcttccctggaaaaatttagctggccctgtgaacagagaaaaattggccacttttcacagggagtgagggaggcgtacagcagctgacacccataaaaacttggccagcccagctgaggaatgttggcatttaacttcagtttctctattagaattttctttaagcccaaccacctgcttccccattccatgtccccacagaagaataacagctctctgtatttgaaccctgctttgtgctctaccagaagttcccatttcattagctgctcccagcagccctgtgaggtgggtcattgggtatcctaatgtctactttagggatgaagaaaatgaaacccaaccatatgcagaagcttgccaatgcagaaagacaggtttacatgaaaacacaggttgccttctacctactcaagagcatttctcttgaattccacgctgccctgaagggctaataaaatatcactgcgtttctaaattgcaaacgaaattgttatccttttacaaatcatgtttctacatttatacagagtttcagatccatcatcattcaaaaggccaggccaaggctgactttcccagttgttttgcaggcggtgatctgaggatcatcagtgatagaaatcagtagcaggaagtctctacggatgagctgtcttccatgagaagtaaaatcaaatataaatagcacagtaatgagcctcatagaggcagggcacgattgatgttttttcccccatttaccagaatcaacacctagggatcttcgacttctcctgagtcaccctattataataaaaataccactctgttcctctcacccaagaaggtcctgtgcaggcctagggactttctgcttgggagggcaaaagacttttggaccatgttccaacttttatacagcccctctcaagttctactgagccttgcttctgattccccatgtttctaccaaataagtaacgtatcattatcacttctaatctttgttctttgtgcattgtatgtattcttgaagatttacaaacactactctaattgcatctgaaagttctttctacatttgttgggaccactgaaatcctccatagtacatggtgtcaccattaagtctaactctgacggaccatggctaccatgtatcttggtctataaaactctagaaagaagaggactgacccaggaatcaaatacctgggttcacaactggaccctgtcatcagctatttgtatgaccttttggcaagcttcagtgtagttggctgaacggtgaaccccctaaaagatggcctaatggcctaatccccagaaaatatgaatgttaacttataaagcaaaataataaactgcatatggcaaaagatgtggctaagggtcttgagaggaaaaatctgtcctagattatcccaggtggaccctaaatacaattatataataggtacccttataagagagaggcagagaaaattttgagatagaagaggaagaagcaacgtgaccacagaggcggtggttggagtgatatggccacagccaagacatgctagccaccaccagaagccagaagaggcaggagcaaatacttcacaggagtgtggccctgccgacaacttgattttggacttctggccccagaactgggggagaatcattttttgctgtttgaagccaccaagtttgtggttaactccttacaacagtcccaggaagctgatccactcagtttccacaactatacatcttccgcatctacaaaatgtaaaggttggggtagcattaacaataagtccctttccaaatctttcactttaagaatgtcactttcagacactggaaaataaataaaatagctttaatattatcacctgtctgacaacctcccaggatgttgttcccttgggaatgtgagtgagaatatgtgagtgagaattgttgcaaccccaatcacccctttaccagaaatcactgtattaggaagctggatgcgaaagtgtcctcctagaggtggacttgtccgctgtcgtctctgtgtcgtcaccaggaccagtccagatccctcttctgttccttcagtgggcacagagctgtggcacgtcagaaacaaagtattaacgtctgggttggggtgtgcacctaggaggaccttgtctgaaggatgtcctgtcttgcttaggctgcagccttccagaaagagctaagggacctgaggaaactcagtaagggagttttcaggaccactcgatgtgagaatcatttcagagtaacttaattcgtgtctatcatttcagagctaaaaacgttggcatttagagcctaccgatatggtgggcttcctctctgccactgaagatgtctcacctcttcattttcaatggatggttttattgcttttcctgcccagaggaccatggaacaaacatttagtcaaggaaagtaaagcacgggttcaaactttctgcacctgcctttaatatgccattgcagcatgctgtaggtacgagaactcattttggaacatatgagaaaaagatgagagaaagaaacctatacagttatgcatcacttaacagtgaggatacattttaagaaatgcatccttagacagtctcatcattgtgcaaccatcatgcagtttacttacacaaacctagatggtacagcctaccacacacctaggctatatggtatagcctgttgctcctaggctacaagcctgctgctgtactgaatactgtaggcaattgtaacacaatgctacatatttgtgtatccaaacatatctaaacatacaaaagctacagtaaaaatatggtagtataatcttataggaccaccatcatatatttggtccatcaccgacagatacattgttatgtggtgcatgactgtatatttagacatatatgtgtatacacatatatacactgtgaatatatatatccctacacccacatatacatatacatacatcaaaggcagagcactcaattcttcccattctactggggtttaggtgaaaaattaaaagaacaaattagagtatacatgtgttccagaagcttagaagaagcctgatccttagttactgctttgtaaactgtggctagaaatggttattatgaagcaatgcttatggggctttagtgccatctggtggtgagttcttagaaatagctatttttcttctctagacatttcatttcaaaggatttcaacaagattaacacatgaggaatgcaatgaaaagaacaacaacaaaacaaaacagtggtgatgtgaacctctgaacagcacaaaatgccactatttttaaactaactgactcggaattagttctcaaagcgtagtccccagaccagcagaatcagcatcaccaaggaacttattaaaaatgcaaattgtcaggtttttccccaaacctactgccttagaaactctgacagtaggcccagtaattttaacaatacttccaggtgaatctggtgctgcattctcaagattgagaacattgctttaagcaacaagacaggtagcttttcctgaaaaaagtcacacctgtgtccctcaaggccaacaagcattcttaggagaagggacaggtgtaaaaaagccactccttaccgtgcagtgatgagcgggagctccgtgccacaccccgccagccaggaggtgacactgtagaccggaggggatcccaccacagagactgattccaccagattgccccctgggcgagccgttccagaatcagcttgagaaactagagaccagtgatccaattactatcaagtgacttaagatggtagacttgctgtgtggaaaatcccagttggaaatgtgagttactcagatctcagtacacacctaaagcatagattcctacttatctgctgccataaagaacacatggagaggacgcaggaggataagccattcagtttagtacaaaaaggaaagtgcaaggtcctgatttaaggagatgaagattgattccatagaaaagttcaataaccccacagctagtaaaatgtcactccctatgctcttggaggcactcctacacagttaatctattgcagtatagcctgccaccctttcctcctttccttcccacagcccctggcaactctagggatgtttagctgatcctcttaggagcactgaactcagaggcatacacaggggcacttgggtgtttatccacagtgtggagccagcatgtgtgcagaaagggtgcaagctttaagagagaccactggtcaaatcctgattttttcacttctattggattcccactcagctaatccacacacactccataagactcagttttcttatgtgtaaagcggggattatgacatgcatgattgatagcaatcaatctgacaaggagagcttagtgagatttaagatttaaaatgatcagcacaatatcaacatccttttagcttcttccccaagattggttacaatggagactttaaagagtttaagggcaacacctttgtctaattcgtcttctcatgcttgatgcttagcacatgctaggcatagactaggtggtcaataaatgattacttgctcagctgggtagatcagttcgagggtcagtgatcattagattccgatctcctccacagctccgctgtgtgaattggggcaaaatactccactccttttagccttggtttccccacccataggtggggataacaggaccaactcatgggcttctgagaactaaacgagaaataaatggaagctaccactatccagtggtagtgggagatacaaagaagtttcatagaggacattagtcaggggaatatcatcaagtataaaattgagatcagataaatgatatacaattaactatgaatattgagcccaattgtgtagtttatgttgccattaaataattctgaaaacaaagccattgccagcagggttaatgtgataaagtgggaggcagaccgtttcatgtatgctacccccatcttccctcttgtctccgccctctcccttcctgctcccacctcacctcacccctggatgattccagatacacagagaatttggtggcaaagaggtgagggcagtaagaaaaagttctgaatccttggcttcaagtgtttggcgaggcagaatggcattaaagggagagaaaagaaaactgaacagcacctattatccagtcctgagttttccaactagtggactccagtgtatgaaatattgattccctcagccttctggaaattgaggcagcacttggggtcaccaaagacccccagccagttgtcttgggcaccaaaaaattcaggcagtcacccagcacgtcacttgagtagtgtcattttctaagtgtgccagagcacaaacaggtttggaacaataagcaatgacccagatgtccccaaaacacttaaactatggaaacagaggagagatgggattttgatgagaatcaaagatgatgtaatttcaaggctgataaagagtcctcttgccacccatccccaagttcccctgccttcagtactgcaatgtttaggcaaaagactgaaaagttgtacattttctaaatcaaaatgtaaattaaggtatcatctttttcttcttggagagggaaataaactataaaaagtaggctagctgagccccaaagccacaagggatttgacagagaaggaaacatgagcaaaagttggaagcctgaagacactgagggcaaactgcaccattctgccttggctgtgggcgcacatcacacacagacacctcagcagggcccaggaggaggactttgtccctaagactagcgggcaagagccaggtgagaccactgtgcccaagagtggtcaagggagagttcgggaaggaagagccgggcctgatctctaaataatgagtaggaagagtctggagagacagaaaggacaagggccttctctctgaagaagatgattaccttctaactctcactgcgtctgtcttgaaggttgtaaatcagactcttggcccatttacagagacagacactgctgagttccttccagcacctggtatgacatattaactcatggaaaggtggagaaatcctgctagtctaatgataacaataataataacaataattgcttatatttattagacaccttctatggacaagaccagtaaggagtactttatattaaactttagttaatcttcaccgtaatctaatgaagtagggtccttattatacccattttacagatgaagaaaccaagacttcccagcaagaaagtgggaaaactggagtaagaatacagacaccagaagtaagagaaaatcgtggggaaaataggaaagaagagggactagagagacatagtaccaaagacacataatcccagccccatctgttttctagagccaaggcaggcaaaaaggaggatcacctgttctctcctcattaaaaaaaacagtaacccctagcaggaaagtttgaggtaggcatgtgaccggcttgtggaggagagagaatttgatgattacctgttacgtttgtgtctgcaataataatttcatccacatagaacaggcccgtctcctgggccagagggagaaggttgatctgatgaaccagcactggggagtttgccggagggggctggagatccccgaagcaacgcacacaagtctcccagaggtcagtgcaatcgaactgccagctgaaaaacagcatggagcagaactgggctctcagggagcacttgcagtcctctccggttagagcccttgttcccaacctggggggcctgtgagctatgcagccaggagagagaccccatgaacccctgcacccaagcagtcctgggtgccaaggctacaaacatcccacccaagatgggatcagctcagccttggttataatgctagtagtcaccttttaagtcaatcattcatccatgacatgcaatgtcagcagcattttcaaattacagtttaactgtgtgtcttaagcaaattataatgtgaggctgtaaccacagagaagattgatacttctggacattaccagtttcatttaggtttaagaccatttacaagacccatgagaattatgtggaaagcactgaatcaagggatcaagacagctgaattttattccagggtcactagctgaatgaattttgatgaatcacaaattcttggggccccaaatttcctctttctgtcatgtcaaagaatgttctctaaggtttcccccaactacgctgttctacaattctatccctatgagaaatgtcagactccctctagggagtagtatattcttaacaactaactgctctggagtcaaacttttttgtcaaataaaatatattcaaatccccaaattagtgtatgaggcccaaatataagaccattagtgcctgaggtgggtaactgtccccaaaacagtgaatcctcccagctgactgaattcccaccacgcctccccaccgattagctacctctcggggctggtcctcgtgagactccagtcacaggtggtattctttaccatgttttgaaagccgattgtgaaggacacaatcatcttcaggatcttgttcatgtggcctttgtatgcaagacacagctatggacaccaaataagtccttcagttctattagtgcaagaagcagtcattcaaacaatacgtagtgaggagtccacatccctagaaccctgccataggctctgagagagtcagcacagttcctgcccttccagagcttaccagtgtagccagagagacaaataacttaaattgttatttccctacctaaataaagctaaggaaaaatacaataaatactttttctgagaccaaaaaaatgtcatcaaacagagtttttaaatgcttagcactgtgcttggcagtgaggattttagagtatctcacttaagaaaacccctgttctaacccaattacccgtgcaacctcgagcaagtaactcaacctctctgagcctcagttcctcaactctaactccccagcatccttggtttctaactcagttaaaggcaaagctgttgccacaagaagactttagagcaggagttttcagcctcggcactatcaatattctaggggctggataattctttgtcataggggctgttctgtgcattataggatgttcaacagcttccctggcctccacccaccagatgccaatagcacttccccagttgcaacaacgaaaactgtctccatacattgccaactcttccctggggggcaaaatcacctccactgggcgcccctgcagaagagatgaggctgaagaagggaggagctcaagcctgaaacatttagccccaactcccacagcagcccaactaggaaaagactagaaactactgccatgagctccaccactccagcaaaactcactctggttcccaaagggcaaatcagctgcacttcttttacaagggtggtggagctatcgaagcaaaggatttaagaagtgtttgcgaaatgcatcagacaattcaatccatcaataatgacaacaactagagtaataataattagccttcactgggtcctaactgtgcaggcactttactagattatctcatttaatctataccacagtcctgagagatagaccacattactgtccattttacagatgagtaaatgaaggcatactgtacttaagacagacatggaaggtacattgggtgtggaatcaggatttaaaaccagatagtccaatgacacagtctgtactcttagagatcaaagaaaatattgtagcaaataaaaactttcacaagtctcacagctaatacaaaggcatttccaggtaacaacacacaagtgggggccagtggtgtccattcatacctgaaacagcagtcgagagacctagaacctcagcctgaaacaccttgggcagatcacagcaatcactcctttgtgcttctgagttttcagtcttgaatccagagagcaataccaatacctacccacctgacccagaagcacaaagactgctactcacgtgtgtatactgatctagccgatagcccttctgggcagccgggggagtaaggacaaggtgtcgaggctgacggaggctgaacctgccacagaagggctccgtcccactggtgaggtccccatcagagttggaaacttctgggcctggatgcagttcagataaaatagaaaggcaggcatagatattaaaaaagacagagcttccctacatgtgtgcatgaggattttagagtatctcacttaagaaaacccccgttctaacccaattacccatgcaaccttgagtaagtaactcaacctctctgagcctcagttcctcaactctaactcccccagcatccttggtttctaactcagggacaaagttgttggcacaagaagactttagagcaggagttttcaacctcagcactattaatattttaggggctggataattctttgttgtaggggctgtcctgttcaccatgatatgggcccctcagccctgggaggaatggccacagcatgagtggtcagcacccctggcttgaaagctccagctataagaaactcattctgtgttccctggagccttgaaaaccctttagcattttctctgtgtagcaggatacggaaaactattgagaagcaaaaagacaaggaatatcaagatggaagaggtgttcaaaaataactagaatttagttcgccttagtagtagttttaaaaacataccctaacattttaagaatttcttaagactactttcttaagtagtaattcctttagatgtaatctgaagattagcatggttttggctatgtttgcatgtttctcacctatgtctttgaccttttcccaccgtgtggcatggggagtataggagggtgctgcactctacctaacagcccaggaggaatgcctttcctttctattgacacccaccgagcatcaacctcccaagcacagtgcagtgccagtccctcagccactcagtgtccaaatccaggtttcatattttttttttactctgttatcaccttggagaggaaatggggattgttctcattttatagaaagaaagaagaccatgatgaaaaagacaatcagaatgaagccacggacagcacctcgttcaaatccaagccggagaaggatgttagaccaaaggggttccagtttgcattttactgcaagtaactcctcaatggttgtttgaatctattacaaaggaaaaaaatgccaggaatttatatcatgagcataaagaccacccccagttctcccactcccctccctcattttttgaagaagtctcccaccagatgggctgtggcatttgcagggattggctgactagagacattgtcccaagtaaggaagaagtttcctctgcctgatacattcagcacctaaaaaagtcaagacagacaagactaaatgatggtgctaattaagccagagagacaatctaagaacacaggacattcctcctcaacttgctatttcctttttattataattttaacttttcaatgctttaacattcagaaatctctgaggaacacagcatcattgcctaatgagaacttttgttggactaacagagatgtcagtcttcctatttatctgtgccccttgattgagagtatgagatgtaacagttgccattgaatgctgcactttcagcccctctcaccaattgctttctcccaagggtagcccagcaggcagaagcagctccatggcatgcaccctctcttggaggcttatgcagtctctgctttgcttccaacacatcaacacattccctgtagggcacattatagttttgctactgagtaagttctatgcagcttttttttttttagatggagtttcactctgtcaccaggctggaatgctgtggcgtgatgccggctcactgcaacctccgactccctggttcaagcaattctcctgcctcagcctcccaagtagctgtgattacaggcacatgccaccatgcccagctaatttttgtatttttagtagagatggggtttcatcatgttggccaggatggtctcgatcacttgaccttgtgatcagcccgccttggcctcccaaagtgctgggattacatgcgtgagccaccacacctggccagcttttaatctcttaaatcaattgttactttctactttgttctatggttatttgtgcacatgttttacttttagactgtaagctttagagggcagagttcatattgatttgtctttgtacaccaaaaagtgaacaacaaaaactataacacataaaaactcttcaaagaaaatatggggcacagctgagagacccaaaggacatgaccttttcaaagtagacttagaaaacacaggctatagggaaataggacctcaatcagtcaaaaattatggaatttaatgtgtatatgctcacatgcatgcacgcatacatgtcgggcgtgtgtttagaggaccttgtctcttttctgggaaataagtttctaaaagaagacttgcttggaacttaaattcctaaaactaactcaatgagtaagataatctcaggaataagacatcacatttttgtaaacatcttcacaatgctgttaaagagatatcctatttctttgacagcaaggttataatgacccctcaggtcgccagactcccagtcagtgctcctgctacatgggactttattccttccagagttcagctccatgggactggaaagagacacagacctgtacttctggaagcctctgggctcggactcggatctggtgcttctcccgtaggtaagtggtgaccacatcaggattcagccaggtgttgtgaatctggacaccaatcctcatccccctgcttggggctatcccatgatgctctgcttccaggtagtacatggctccacccaacagctccaacttgggagtcttctgctgccaggtcccttcatccctattctgctcccaggagtcaaaccagtcagcagtgccgacgctgatggaggccactttcacctatgcccaaataagcatatcatgatcaatactatgcagcttccaggcatctctttctcaaacactaagtgtctgaactgctactatcaagagagttttgaactggtctgcctttttaacatattaacccagttacctcagccctgtggttatttatgcttctccagctctctatctatctatctatctatctatctatctatctatctcttacaattgagtagtactcaaatgagaatagatgggccatgttcagagaaggaacaaccaacctaaaccctaggattacatgacactatggagaaggtagtattaagcccttcagagacctcgaatgacttgatcacatcaaaatctatgacatttctccaataaactagcaaatcaatttcagacatacatagtaataatttgaggaaaatattgtgattctttgtcaatagcataagtgcattttggctgctgttaaaggcatcttttcttatccttcaatgttgttgaggaattcctacatacagctgcctacatctccacccaaaattagtggaaaaggcacaagttttgtagtcaggtaaatttggggttgaatcctcaatgtgccttttgctatccaagtggattgggcacacaatctttcttttttttctttttctttttcttttttttttttttttttttttttgagacaaggtctcactctgttgcccagactggagtgcagtggcagccacgactgcccaaggctcaggtgatcctcctgcctcagcccctcaagtagttgggactataggcatgcgccaccatgcctggctaatttttgtatttttaatagagacagggttttatcatgttgcccaggctggtctcaaactcctgggctcaagtgatctgcctgcctcagcctcccaaagcactaggattacaggaatgagccaccacacctggcccacacaatctttccaagcctcaatttcttcatgtggaaaagatacatacatatatctttatgtatatatgtgtatatacacacaaacacatacataatatatatacatatatacatacatacatacattttgcagagatgcagtgaaaactagagacaaggtctataaaagatgtagcataatatttggcttacagtaaatgctcaataaatagtacgttcacattcaaacaagttctttttcaacaattaaagttcctgatcatccaatggcatgttaaactatctgtaaaacatgagagccttaactttgattctttctttcttcatgggtatgggactggcaacagagaaaaggaaaatgagaagacagtgaataccttagtccttggttcctctgaccaactgaaatgcaaggaagcttggctatctgcctgaatccagaaagtgtaattatttgtctctggagccacaaagaacccactgagccgtgctctgtaaagtagaacatagagtcaagcaagagtaaccaaggcctgaatcactgaaccaacaaatgactgcccttgtactttgtcttcttttatggtaataaagaagaacaacctgattcttatgccacacaattgtccagaatattctagaaagagatatagcacctgcctagtctcagtagcccaatacatctctacactggacacaaatacccttgctgttgtgtcatgtttgggaaagttgtagccacagcacacagctatacggaagcttagctgacaaaaccacctaacacagctattgcaagccctggatcatggtagaagctcaatctatagtaaatactattcttattattagaaataaagacagattgcttatgagaatttgctctgagcttaccagctacctcaacacctgcagagagcatttttctaattaaaaatattatgatccacagataagcgtcaattcaaaatgtcaacaatttcaaattaaaacccatcaaatgcaactttgaagaagattacaggcaatttcataaaacattttttaaaagataatatttttaatatttaaattccagcaacctaatattataggcagatatagttaaagaactgattagactctgtaaataaataccaagaatattttctgataatgctattttcttaaatcttcagatgatcaatataaagatgtttttaaattttgctttaatgtacatacattatctttatttttgagataatttcatacctaaaaatagcttcaaacataactactttaaaagtccacaatataattatattaacttaccaataaatgaatattttaattttttaatttaaaatttttagattttaaagagattaatgagagagggaatggaaaattagttactacctggcttgtggttcctcaaaatggcagttaaagggacataccctgcaacacttactatagaagtcaaaatgttcttttgccttttggggtaggctgactcactccttaacactcccaaatacaccaaatgcagctgaaagattttcctttgaacattattaaatggtcgttaaaaactatgataaatatgaattattaggtgctacaatggaccacaaattaactgccacatttttgtttatttgtttctttgtttaaagacagagtctcactctgttgcccaggctggagtgcagtggtgtgatcatggctcgctgcagccctaactcctgagctcaaacaattctccacttcagcctctcaagtagctacaggtgcacaccatcacacctggctaattttttattttttacgttttagagacagggcctagtcccaaactcctagactcaggcgatcctcctgtctcagcctcccaagtagatgggattacaggctcaagccatagcatccagccttaactgccactttaaaaccataaactcatggttaagtacctagtaagtaaggcttcaggagacactttcctgctcacagattaccaaccctacttggcttattcaatgcctaaaaattctctaagcttttctttacacaactgagttgaaatctattagattggtgcaaaagtaattgcggtttttgccattaccttcaacggtaaaaaccgcaattacttttgcaccaacctaataaaatggtaaaatatttggaggaggtcacagactgactgaaattcacactcatgagtcacagtcatcctctctaagaaggatttcaaagggaaaagagatccatcattcagtaaaggatccatccttcaacatatacactgagaacacactaaggaaacagtgtgtctaagcaattttcaagcttttatatttttaagtttactttagaatactagaaattttggctacatccttgaagggactaaaaagactaaaggaattacacaccattaaacaggaaaattagaatcatgatgccatcactactactgaaaacaatgtctcacagaacccgcaagagcttcccctactatacaagggccattgggttgaccttcagcactggaaggctgttcctacagcatgctgcctaggctttgctccctcatgtacccaaagggcaaattcttggatctttctttggcatcaaccagatgttagttttacctcttaaccaggtacctaaagcatgttttactctgctgtctttccagtctcctggcctgctcagctcaatgttctagttgataatcatctccaaaacagattgtaaactaagttgtggaaaatatacatattacatattgatcaaaatttgtccctgcactagcatgaccaacactgattgagaatactgtcaaactctgttgttgttgaattggctagtgttataaattcctggaaatcttgataccttccttatctgtctcctagcctcacctaggttagcaaaggtgcttttgatgtgggctcccacttttcctacaacatacctgaaaggttgtccttcctgtgaccaaaacccaaatggagaactggcattagggacaatctgccacctgtaccctggggtggcttcagtcagttccagtccctcaacagcatctccaacttcaaaaagaagccctcgattgcctgtaagacatgtagatcgcataaacattacagggcgcaccttcccaaattggggaattactttattttaaattacaaggtgaaagatgacccagatgctacctgtaaaggtaagtcaacctagagccagatagagtagttatatgaaaggttctgtagttaatatgaaatacaaatgttccggaaagtaataaacattccatgggttaggagttagccttttttagcaagagttcctagaaaagagaatcaagtcctggagaaaatgtgaattgaatgagcaaacagaagctgaggctgagtaaaaggaggacaatgtgactgtgtgctggtgacgtggcttggctttgtgcttcccaaagccagaagtgggcttcagtatcttttaagtcccagttctgctgtgaaattcaattctctaaagtcttttttccccataacattggcaatccttaagtttctcaagtgtcatggcctcaatttgtggacctgcacacagagccaaatatgtggcatgctgctattatgtgacattttaaatgatattgtattaatttatattttgtgttaagcaaaccctgaggccaaaggcacaggtgcaatcaatattgaatgctaacttgggctgaaggcaaaactctggaatcccagctagacgtgtagctttgagcaaattccttgatgtccttgcatcttcattttctcatgcatcaaaatgggaccaataataaaatagcaataatacactaggaccaagggaaaatatatactcaaagagcctggaatacagtaagtgctcaataaaggtaattatggtaattattattttaaactaatactgttgttcctcaacaactcctaaaagggagaggtggataaggaataaacagaaaagtaagagcatattttgaaaatattactttaaaccagggtttctccaccccagcactattgatattttaggctgggtaactgttgtgagggggtgtcctatgcattgcacaatgtctagcagccttcccagcctcagcccactagatgtcagtatcatcaccaccaccaccacttccggtctaacagccaaacatgtttctacacattgctacgtgtcccccgaggggcaacattgcccctggttgagaacaattggtttccatagtaattcgcccagcttctgtggaagaaacttcaaaagcccttcataaaggacaacactaactgtcaaaccagctgcattcaggaaattatcctaccactacccaagtagctaaagcaggaaatactgaaaaagggagcagactctctatttcctgacaggaaacacacattatcttgattacttgtttcagtagttttgtttccttggatggaagctttccctgagtaaaaactgcagatctgggagctggagaattctcaagccaaaactttgcatgcattttcacacctgaatgccctttctttagaaaggtttcttcccctgctgggcaactttccttgtaggtgctgtgcctctagagttgactctcgctgcctgtagtttaaccattaagtcaggcccttgggcacagatgtgcagcctgtggttcttggctgagtaacataccaactgcccttcatccctgactacacttgagccttcagttctaatgctcagcagaaaagtgctccagtattgtgctcttaatttgctgctgtagggtggatgctttaaacagagaaggacagctggaagctcccttgcctcctccatttctgcccacttcaggcataacctggtggcaacatcacaatatatccctgtttctcaaagcagcagacagatgcccacaagagagaaaaattcatatttaaatgcatcccattgtgccctactctccgaccttgtctaatgctgttgttttgagcatagcagagcacactctaacgctcctgtcttcttagccagtggacgtgcaactgacccattgaatgaaggcgggcagtttgggggtttcttccagtagctataacaatatcttgagggcagttatgctttctagaccatggtctcttctggacgccactggccatacagctggctggagctagaagtgcaatgtcactaagcacctgaataaagctaagagccttcctgaaaggagagccttgacaatggtatcatggacccagggctcactgagtaagccagtcaaatagatgagaaagaattcaaacacttttatttctactcgccagcccatcatgattaaagatattcagagtttattgaacagccctggtggcttccttacctggctgaggggtggtgagcctcacatcttttcctggagcccgagtggtgcactcaatcttcctgggagacacgtgtctaatatcacatggaatgcctaaagcgaattaaagaaatttatgtatgtgtgtgtgtgtaggtatacatatatatgtatatgtgtgtgggtatatgtataattatatatatatatatatatatatatatatatatatagagagagagagagagagagagagagagacagagagagagagaggcagtcgggagatgtgatggcaagaccagactgaagtagacaggctcctattctaaggcaaagggctgggtgtggatggaatagcgaaagttgtcaccccaattgaaggagaaaagagagagtgcagagcagcagagcatagggcagcgtggagtattcagaaggaaagccatgcaatggagtgctcttcattggggacgtactgaaccacctaactgagcatgggaggtaagtgtgacatgacagtgtgaggacacccttggtgtcaccaactacagaggcatcccacctgctacaggacctggcaaaacaaaaggctctagacaggtccataaaagggtttgccaaggttggggtgcgggggatttccagagtaatctgcatagcaaatgcccacccactcctgcttgtctatatcaagacagctaacaagggagagtgaagagaggggctgtttttagtagaagtaaacctttgtcaagaaggagctgtatttctttctttctcttcactcacaagataggggcacctgagggaattgcctatgcattgtgagtgtgtctgcaggacattccattcctgtgacccatgtactgtaggaccaaaatcccacctggtctcaaccaaacacatgacttatcaaacatgatgagtcagaaggggcaaagcttgcttcctcctgcatccctcatgccatacagacatataatctcctagagcatctaaaactatgaactattttcagccatttcatcatagttacctgcaatggtaacctgggcagaattgtcaaaaaagtctcctgtaattgtgatgtttgttcttcccccaaggctcccagtttctggaaacacagataatatttctgcaagagttaaaaaaaaaaaaaagtaagcttccaaatatagaccagaatatgacctagataataatataataataggagatattaataatttcttactttaactttctaagtccagcaacagttgaatttttttctagtaataactatttaaaaatgcacataataagaaaaagaccagaagtatatattatcgaggatcaatatttgaaaggaaggggaaatgtggaatcattcatggtatcagcaaaagcccctagtaccatgacattttctcagaaaatctgtctcctgacctcaaggacaatattgacaagtcagggaacagtaagttacaacacaaggaggaatcaactttgggtacactgggaaaggcttcagttcacccatatgaatctgtaatttgctctaagcagaagaatgaatttcactgtctttaggaccctcccactctttcccacactgaatgctccttccccacatgtacctcacacctcatacccagttctttcatgctgctcctgattgtttaaaattgcctacagtgactcaggcctgtaatcccagaactttgggaggccgaagcgagtggcaggtggatcacctgaggtcaggagtttgagaccaacatgaccaatatggtgaaaccctgtctcttctaaaaatacaaaaattagccgggttccgtggtgtgcacctgtaatcccagctgcttgggaggctgagacaggagaattgcttgaacccaggaggcggaggttgcactgagccaagatggtgccactgcactccagcctgcgtgacagagcgagaccctgtctcaagaaaaaataaaataaaaaatttaaaaaaagaaattacctacagtaatatgacacatagtcctcagaatttagctttatctcattctttcctctcctacgatcaagctttgacatttctaagattcattccctccagagaaaagaggagttgcattttgtgtaaactgaaggtacaaaagctaatgatgaatggttacccctgaaaaatagacattttaggaggttattttataatgctttttgcccatgagacaaagcagaggagacatatggaggcaaagattgatcccttacactcagataccaaaattcaccactaaaccataataaccccctgcttttaacccactattttataatttctttttttttacactagcactggaattttgtatcagctttacgtagagattaacacattcttttgttatgcattcaaaattacacagatcaaaaacaaaatttatgaagttcttaaacttttaacatagttgtagatatttgataatttttttcaacattcacagagcacctattatatggtactaggaatataaagatgaatacaaaatagttcctgtcctcgagaagatcagcatggtaaggcaggtatgcaaaactatcatttaataccttgggtcggagaaattagagagtatatgaaagaatagagaactttgggagtaggatgggagtattgaggtgtagaagaaaatgtttagagatgacactaatctgagtcttaaaggatgaattagaagtggcctagcgaagaggagaaggagagggcatttaaagcaaaagatagcctgagtgtggacagaagaaattgcacagtgcatgttaagtgtggctggagtatgagagacagagataaagctggagaaacagacaaggaggaggtcagaagtttgccccatttccagtaggggatagcaagccataagaggatggtgaataggaaggaaccatgcatcagatatatgcttgatgtagagaaagccagggaggggcttgaaggggcagagggcaagtcagggcctctagaaaccactgcagcatgtaacacaagaggtgatggggtccagaaatggagagttgctgtacagatacatcataaataagagagaaaactggcagaaattggtgattgaacagatatggaaaggaggaggaaggagaaattttagatgaattccaagattcttgctcctctacctctttagacgacttttggaataagaaggataagcaccactttgtcagttttagagatgcttaattaaggctcaaaaagcttaaaaggcttaactagtgattgaatgtcagcccctgaggagctcagcccagggctcttcatggctgtctacaccctctcttcctacagcctgctctgctgtgaagaagttctggcctgtgagtcctgatcccaagaagacactgccctggaaatgtaaaagagctgtgtcatcagagatacctgtcagcctatcagtcattctagggtttgatagcaatgggcaggctcacaaaaaccttggagtggagtggcaagaagagtgtgcttcccaccatatattggctatggacataagatttggaattagaactacacattctagctctaagacctttggctttggacaagatactttgtttatctgagtctgtttccttatctgtaaaatggggctaatgttaatccatctcatagttaagtgaaattaatattgagattgtatgtaagacacttaacaaggtctgacattctttctatagcagctatcgttatcaccatcaccttgggcgcttcttcaaacttaccccaaatagactagcaatactgttgaaagaaaggaaaaatcagggtcaaaatgcagctgttgcaggattaggctatctagagagtaaatgacattttctccatgacctgtgaattatcttgcacttttgacaaaggtagattttgattgcttctggaatctgaaccaaccccacagacatttcttcagtggctgtgtgactgtattccattctagaatctaagtattctttagtagccagctttctactaccaaatcgagttcacaattccaagcaagcttccaattttcacattcatttttttagtatgagggtttactcatcagatggcaacagaacagcttaatatcaatattagtcataaattattgaatgaatgctcagagatggatgttaaagtaactggaaagatgtgctttaagactttttaagtgccaccttttttcttttactttcagaagacagaataaggcaagactctcctttcttttattcagtttatatccatagaatttgtatagaagtttattatcaagtctcttttaatatattaactaaacctgacatggatacaagcaatttaatctcaaccaaaaacaccaggctgtctatgattgtagggacagcttcgggtgttaatggtcatcaagaaatggccaaaagatagggaaggaggggccaacattgagtgaggcacaagggaaggggtacttggtgaagggggatagtacctgagtgtgtctggtataggaaaagatcctgtttagcactgatcagccatgccttcttgtggaccattgaccttcgaaaaagacaaagttctgttttgaatgaaaatatcaactgggattgcattttttttagtcggctgcctgaaaggaagattgggaactaacctctattgatctttagaacagttgaaatagcagctcccttggataactaaagaacaataccaacaggacaaagttgttttctgatatataaaattatcatatgggaataatgcctgcttcataggatgtcccaaatgttcaatgaaatgatgagtgtgaaagggcctagtccttagttggcctatagtcaatactcaatagacattaattttatttcttccaaaatgagaaagagagaaaatctccatactttgggctgtatagctataattgtcactgtcattacaaggcaattattatcaattagaccctacgcttttaacagaaacacctgtcaaattatgtaggggcaaaatataaggtaaggattcagaattccagaatgctaatttatcacttcaaagtgtgataaaatgtggaccccttccattttcaagaaggcacttcctagatggtacaatgtatttcatgaaaccatgttccttataagatacttgtgacagttttcaacctacagtactttgaaattacttaagatttaattcccaaaattctgcaacaccaccatattgaaacacacattgcctacagattagtgaagaggacacaacttcattcacccaggtaaaaaagtcaaggagttatatgtggtctcattatactattctgtttttatatgtttaacattttccgtcataaaaagataaagaaagtaagcaagatgagagagataggtaatataaaatgaagacaaatttgcctatttctatacccagttacttactttcctttgttaaatactgagaagctaacattctgggagcctgtaacacaaagaaacacacattaactcaggaatctgcacgagtcttctgggccaggccattgctttcataagcccaaagactccaatatcatcaaattaccacccaaacctgtaatttctttagtggttcccccccgcaaaaacaaacaaacaaacaaaaaaacaaaaacaaaaaaaaaacacctcataagtttagcatcattagcaatgtggacttctagcaataaaagggcaaatgcagtattgcatagcagggaagagcccaggcttcgagttagatggagcaccatttaaatattgatttactggtaactaacttcaatttttctcacctgcaaagccaaaaataataccaccaacttcacaggtgtatgtgagcattaaattagtttctatatgagctgtttcatatagtagtattttccagggaattcttaacaaatagtaattattgttattattattatcctcatgagaaccaatcttgcaattgcttttgtccggatacagagaaagaaatggataagactttaaaattatgttacttctctaacagaccgatgtagtcgccttccacatggcactgcagagtcccaagaccatggtcctcctgaataggataactaaggaaaagacaaactgaggtaagaatgaccagacaactcactaccagaagatctgactctttaaccaggaaagtagaaagcaaaagaaaaccaaatttgctagagaaaatggtagacagagaaagtataatgagttcattagggcaaatgcttagggtaatactaactagtattaccctttatatatactagttagtaataccctaagcatttgccctagtgctaactagtactaccttaagcatttggtcctttcttttcaaatgtgtcatatgacaagtataacaaaacctttatttttaaaaaatctgttatcaagtatgaaccccataaaggacaattctgagcaaacaaaatgcagacacaaggaagactacacacaagggcagaatacacaccagtctgaaaaagtgaaaccatagagtatcattcttgtaatggcctcaaaggaggggcaacacaccctgtccagagtgaagtaaaaatccagcaaaacattgggtatttaaactggagagtgtagaaacttatttctaaattttttattatttttacctttggctagtcactgaagtatagtggttaagatcatgaactctaggggatgattagttagacagggttcaaatcccaggtctgccacttgctctctgtgagaccttgtgcaagttacttaacttttctgtgtctcaaattcctcatctataatgtgagactaataaccatacatactcccaagattattgggtgacttcaatgtaaagcattcgagcagagcttggcctatggtaagcccctaacaagtattagctatgtgttttcaaggaaggttttggcatccacttcaatacgcactttgaatcaatccctgtgtctttttcagtagtctaaagataaggtagtaaatagctatgtgtgatttatattttaaaaaaacagatatatggtgagtggggagagaaagagagagaatgtgtgtgtgttgtatccatgtggacgaacttacaagcatgtgcattggcaagataataagacactcaccagcttcccatctgcctatttataagagagcaaggagtaacccatttgtctccttgagcttccaagatcactgggctggatttaaaaaaaaatgaaaacaaaagacaagagataattgtgcaatactcccaataaacattcctcacaaaactcagaggaaacatggctatgaacactctcctctggatttttctgcactattgcaggtggctgaaggcggatgtcaagtcaaattctcagcagagagtagggatgcactcatggctcatgctttcacactaaacagaaaatagttctcccttcccaaaaaaccttcatcatctccacactggctatattgattctacacagagataatattgcatttatgcctttattccccctttcaaaggctgtatcccagaccaaggctgagatgggatcacctagcaaaatatggcacattcccaaggatgtagtaggagtttctaccccccacaagaagagtagttttcttgtaaggtaagttgaccattgcttaatgccagaaatgtcaatcctgagagtaataagatcatattctcttcaactagggcaaaatcagacagatggagtagaacagaagaggatgcccccaacccatccagagtgaaggaaaaattagacaccatgtatggaatctatgcagctgagtatatagtaagatcattttccttctaccttataaatgctcagtacaattgcttcatttgttgaatgattacagttgcttagagcttcctacagcctctacaatttcaacactttttgtcttgttctctctctccagtgtggatgatttaatagtaacactttccaccacgtctccagtgaagaaagtcatgttgacatcctaatcattcccagaaaacattaaaagctctatggcttttaatacctgtgtccatgttttcctctgaccccactaatacaatttttaaagcacaaatggataacaaccaaataagaaagttataatgggcttttgggtttacacatcattttataaagaatctatttcaggctgagaaacaaaggaaggaagggtgagaattcaaaaagaaaatccacagatgcaattacagttcatttcacactgagcccagagtgactagttgtcagtaaataaatggaccaacttaattgaccagttgcaattacattaacaaagtttgctgaagcccagctcatgagggaccataaactgcaaaaaggaaaatagcaattctgtgccaactgcttacaatttattgccatcagggaagctggtcccaggaagccatgcagcatgtatgtaactagttaaacacaaaaacaaacacacacttacctatcaatgtactcagcatcaaaatcaaaagtttccaatcttccagtgataatccagccatatacatgtattagttttcctgtttgaagaagaatttttttaatttaatggacttagctcaaactcaatgtataataaaaaaccatgtttctttttggttgtatatactcaatatggcaaagcaggtcatggcccagaaaattaatacttttaataaattgtacaacagtaaggtcaagggtatgatttagtgatcaatattacacaatataaaagctaaaataagcaattgtttcaatcacagacttaatcttctaatgcatggagcatagaaggaataatgggtcttcttcacagtctcagattgtgtgaacatttcagaaaggaggggctcatctccacacactgccctgttccattctcttggctctgtggagaccatctacccaacacgagatttaaggacaatgtgccttgggtgctccaggcttcatgagactttcctctgggcatttgctaaaatgaacatgtgatatgaagaggctcatatcacacaatctgatgggtcttcagggatcccaagtatgtgccttccaaataattagaatatttaaccatgtatacttaaaccatcacagacaatgtttagagataaaagaatgttggttagtgagataaacctcaaggaatagaagagaaaagcatactgagggactcatgaggtcatgaaatccagaagactgagcctctttatagacactgaatgccaccaaagaatgtgacaaaaaagatgttcccttcctactgcacttgtgtgttattagtaagaagtgactttcatctgcactcattggatgactctcactaaaacaacagaaatctttcggaaggtattacagccacaattttataggtgcatgggtagaatgacctaatgacaggcaaaggtcacagagttggcagaaatccagagtctcaagtttcctgttactgctaaaaaaaatctggcagaataattctaattttaatagggctaaatgatcgattccctagccttggtgagtatgacttctagctttgacaggcacaattttaaaactaacaaaagactgtagaaattaggaatttctgtgggtttttgttttgtttctaaacgaagatggccagcacaggctgacaaatggccacaccagagcacggtgatgggggattccatgtcgtagtgaaggactgctaaccacgtatagaaacccaactgctcagaaagcatcgtctctcttgtccctaccacctcccccatctccctggctgctacactgggcaggcttcccaaatgaaatgagagtattcatctggaaagtgattacaaagatgcagtcgtatggatcctgcccaggggggaccactccaacccagcccgccaccaatcctttccccagaaggtggaagagacaccgagcagaactccaacttggtggaagaaatgggcttggcagatctgggcgccagctgacattccatttcacacctctaatggctgtctgcttcctcatccctcaccctaacaagacttctgccatctacacaggagtttctaacatcagagcagcagggacccacatgtctgcatgtgattttcacagaccacatccctctttcataaaatatcaggtcccaatgattcagacaaatggaaaggagcagatctgtgaaaaacccacatgagcaagagcatgccaaattcatattctctgaaatataatttaaattcactcatacataatctgtgtctatacacacaaacacagaaaatataaaacgcttttcaataacttagatcttcattttgacatgcttgagcagttgagccaatcaaaacaacaagatccgtctatgcatttagacacaactataataaaaatttagcaactttttagcacactcttaccattttggaaactctaacaaatggaaaaccttaaataaaggtaggaatttggcaggaatcagacagcaaattatatataatcctagttgtgtttgctacttagttttaaggcagatttagcaattcctgaatccacttctcagttgcaatcccttcttttatgtaaatcccccagctttatataatcttcttttctatcctcctggcttttaaatatctgtgtgctctctaactttataaacaaaacccctagatgaagactagagttaatgaccttccaagtggcatccaatgctgctcaaaatatgacagaatggtggatatatgggccactctggattctggctgtctggttcaaatctcagctgtggtatttagtatctatatgactttcggcaaatttcttaaccttttgctacctcatttcttcaactgcaaaatgggaataaaaatagctcttctattatcaggttttggcgaggatctagtaagatatctgaagagcttagactggagcctggcacacagtttaataaaggtttattattatgggaatgattataaagttaaaagcaaggatgactcctctttcctccagtctccaacatcaactcatttgattttgctgtcctctttttcttttcatgtttggattccttttgttatcagtgaagtaatagagcaaaagtgcccagaggtaaaaccaaagcacgttaaaaatgaaccagaggttgactcttattttcaaaacagcatcaaagaagaagttaaattttcccactcataaaaaccactcacctaggtttgcaacaagctttggcaaacagattcacaattattcctattttaatagaagatttcttacctggaacaccacttggtggataaacttggtgaacgatgggtgtctgcgccttggaaaactgtttagaaaatagtaccacaagtgagcatgtcattaaaatattcacaaacacaggaggcacaagcctttcctcagacagcattacttgaaggtaataaatgcttatatttactcatgtcaccctcacatctgtctagttctttttatctttgtaatatttctatgaaacagaaatgatagatattatcatatttctcctatagatgaggtagaggtaatttgattaaggtcacatagccctctattctgtaccatattgtccaaaccttgacaagcctgtttctacctgcccaccttccatacccaagaacacattttactagaaggaaaggtagacaggtctttgtgcagaatgtcagtcttttaattccattgtaatttgatgttttggggccttgaagattttgatttttctagaaaggaatgcacttatttaattgaatcaaaacttcaaatcattatcagccagcaccttggtaggtatcagtaagctacaaaaaaatgagaaactggataggcacacaactgaggtgcttactagggaaactgaagatacctgctgtgagggaaatgactcaaaagattcaaggaatgggaagcaacattgttcttcaaggaggaggaaagcagcctcaatgggagcagtgagagcctgagaaagcctggcggtagcattccaaatcatcttacaatgccccctgtccccaaagcacaccctctgttaaccataagctccacaaaggcagggacaatgcttgactgagtcgctgctgtgtctctgtgcatagactggtatgcagacgacattcgaatttttgtgaatgaaaagagtcacccaatctgggatgactgatatactgcctggaaggagaggtgagaacgaggcaatcccaggaactccatctcacctgtaggcatctgtgttagtctaagattagtgcattactccatcaggaaatcacagcagggccagtatgaagaaacaggaaagcttaaggatgaactggccagaccaaggcttgacctgtgagccaattacttacctaggaagagacctagtctccccttccctcccctcccccaatcccttctagatgcctagactaccaccattccacacaacctacagtgcttcccatttgcaaaacaaattacagcagcaaattgttttgtttggtctgcttccagcacctcaggagtctaccttcccagagagaacatcaccaaagaataactcggttgttaatcaacagccttaatcagattgagaatcaacagacatttcaacaaagctgatggtggcttgccaggcgtaggttttaagtattgatccatatgctgtatagtctgccatgaaggctagtttcctcactgtctaaaggaaagggttagaaaatagttcacagaaaatatgtggtgtcagggggtcaaaataacaatgttgttacttcacagcttgggaactggctctgatctcaccaaaagataaagattaatacagttacacacacacctgccaaacattcagtccccaccccaccctcccagccaaccactgcccctaggccttcatatcaacattatttcaactggactatatcataggagcttagtgaagtacagtagtggttattgacctatttcacagatgtttagaacctgaggcagctggaacaactgagtccaaaccaaataaggaagcatacctctctatttcaacctgaaatctaagagccaccactcagtctataatccttctaccagacttccatgggaaacacagcaactcctttattactccctcccagctcgtgagatcgtggtggggcaggcttggggttaaacctcaaaaagggcttcacttgtgattctctctgagctgacacaacataacatggtacgtttctaagagaaacaggcccctggtcacccaccaggctagagacatgacaaagtgaaaaattaatgagcttccaaatcaagcttcccgcatgctgatcctcgggccccagtgtggtcagtagaagcaaaagaggggagaggaaatgcagcagattaggatgagaaagctgcagccaccagctgtgtgatcaaccttctgtgagttattcaaacttgtcagcgcccacagcaggctctttgcagtggactggcaagatgggattaatttttaatactcatggttccccagtcccagtcccaaaacaaagagacacgccgtgttttatttagcctggaatgcctctcattaactgcatcccctggtgatttttcatcaacttgccaagatagttgaaccactgacggacttgttttctttcatgtgcaattttaggaaacgtttctcttatttccccctctcgctcctaaccaatcttttaataagcaggaaaactaccatctggggtgaaaaggatcatggtgattaatgcttggacttctctcttctgttatgttccctgagacaggatagaggtggtggtgcagctcttagtaaaaaagaatgatataatgttttttctttctgctgcatatgtgcaaaagcaaaattccagaaaacaagattctcttggattaagaaacaagttattaaacctgaaacaacagcaaattccaaatttcaaaaccaaatagcctatatgaaacacggatcgtaggagagacaaatttacaaggtgaagccttattccgaaggagcattcattagtgactgcattgtatgttttgaaacagctcttaaacagaggtaccccatgtgaagggcaaccacatcgacaggagtaccgccaaatctctgcctttcataaaccatctaggaccttttcagagattgtttaaaactaatctgaaatgaacaacagactgaaccaaatataaatgaactcccagtataggtatcaaggctgtaaaataagtcaggcatggcttcctaaacactctctctctacttcctttttgatctccctgagcatgaaggagaattccagcagcaaatgcccttttggttcagtgttggaaagacttagcagaaatataccaggaagcagggagagaggtagaaattgggtctcctcaccaaggaacgtggggccttgagtctcttcaacatgctgagactcagcatgatctgagctgtaaaatgaaacacccacaaaagtaatcttggtggcccctctatgggcttctattttgatgagaatttagaaccagatgcaagttgaagtcttggttctgccatttactgcctgatgacatgggcaaattatttaatcaccctgagcctcagattgttcatttgtaaaaacaggacagtaaatagctaccccataaaattgtgagcattgaatcaaatgatgtacataaagcatttagctaaaggctgacatacaaacgttcaaaattcatctttcattagtataatataagaaactctgtcattaccatccaccattttcttttaacccggtcaagcagacacgctggctcatttacaatttgcctttcaataacacaagcacacccttagactatgtaaacataccttcctccagccttagaacccaccttgaaagtacagctatctcgtggtcctggatttggactgcttaccagctgtcccccgaagtatgcttccaggaagtacagaccctcatgtgcttcagacagcacagatctgaggacagaaagtggaaatccttatgaatcaaaaaccatgaattcccaaagctagcagcccacttgccacttcaaatttcctccttgcacttttaaaacagagctaaccaaggattcccagcagtcacctttcacctctttgatccactcataattattagactttaagaactgggtccttcagcaaaaaaaagttatgattttttgtgttgaaactccctgaattgtttttaatatgtcatgtttctcaaaatcataggttcattggactttaagaattagaagagactttgataatctattccccatttccatgtttcaaaaaatgtcagaaaaactaagagacttatgtgtatgagcttcaaacgttaagggcaaagtggggcttgaatttaggctctttctgataattgtccaagcagcccataaatacttcatgtagccatcaaaacagagtcttggatcttctctcctctttatacaaatattgcagtggcttcattgccacctgatgctgacatccatgttgatttttgtaagaggaagaatatgactaataagaaagaaaccatatttaagacatgcctcctctccaaaccttcccaacaaaatctttagtatgaccttaaatatttagatctgaattgtccattgtgttagccactagtcttatgtgcttatcaagcacttgatatgtgggtagtcccaattaagatatgccatgattataacatgcacactaaattttgaagacttggtatacaaaaaagatataaaagtatctcattattaatttatatagattacatattgaaataatattttagatatgttgagttaaataaaatacattattaaattaatttcacttgtttcttttgactttttcaagtggctaaatagaaaattttaaattacatttgtgttcacattatattttgattgtgaagtgctgcttttgatgctgcaatggctgttttagagaaaacaattatgtacatgtttttatgataatgatgaataagacatattttgttcatgaaaaactgtacatttttcacacttaattgaatctgatatttgtcttccaatcaattagtatatttaataggatcatatttcttttctttaaaaagatgacataaaatcaatggtgcatccaaaaatcattagtatgttgggataaaggagataggacatgtaaatctccagagctttgacttgtttcatggcaagtctttgcagaatgtctatgcccaaatgtgccataaaatctaagggaaatatataacccagttttaaaaccaatagtagtggtataaaaatgttaaattcaacagacatttattgaacatcctctactcgtaagatattgcgcaatgcatcatgaggactacaatggtgaaattaaacacatcccctgccctcaaagcacttaattctgtgaggaggagtctgacaagtgggtaactgacatataagtgttatgaaaactcagagctgaggcacagggtcactaaggctacacgtgctgtacctttgtgtaaattacaaaaaaaaaaaatcccttcggggtgatgaattgcacagaaaagtgtgggtacacacacatacaccctgtggatgaattactacaagttgttccttctcctttcaaaaaagggaaagataacttagttgaatgttcagggaaaaggtggcatttgtggtatggttggtgatttccatagccaaacatggaagagggggagacttcctcaaagagagaacagaaaagaaaaggaaataacagtgttttttttctcttaaccaatcatctacttgcatgcactttatttactcatgcctaagacatgagtaaataaaaatgaacatgaactagtctaaatttcacagggcaacaagaagttgagtagaaaaacagattccctggagtcttataaaaatattttctaaatagaggtaatgtcaaactcagcaaacagagcctaaagcaaatttcttttctaaccagtttggggtttatgtgcaatcattgcaattatgcctattccaaaagatgagtatttgcaatggcaaaatggtaccatttattaaaatcttaatagccatagaactctttgcaaaaaaaaacaaatggaaacacaatccagcccctccttacgaatatctcaaagttcttccccatactctcatcctccgttaagttctagaccccagatagggaccttttagaaagcatattcacatgaaactttttttaacaactatggctggcaattgaatcacagcaaaaattgctctaatatgtcaccaaaagatactgagataagcaaaaatccctcatcctgtctggtcttcctattcccagacaggtatacctggtccggcatgtcaccacaggcaaatccaagaaaacaggaaagacgtcacagggaacactccgcagtgcgggcaccaccatgttcacgttcaccaggtgtatctccaattgagagccattgttggggtaaagaacacccaactccaaacctaacacaagggaaagaaatctcaggctgcatagaattgtcattgacacaggacagtgtgaaactgtgctaagatcctgggggtaatgtaagacattaaatttgcccaaggattaaattaatactcctcatttcctcatagatgctgtataaaggagttttctcatttatgattttatgaaagagttttctctcttcaggttcacctaaatccagaaaagaatttttcagccctcagatttactctttactctgctggggatggatatgctaagcaatggtgcagaagctcccaagtagaggactgtctttaaggaagatagccaagattctgggagatgcattgctgagcactatgctacacacttccatatcatctcatgtagaaatcccagagtcccatcccacagcctggaatgggaaagtggacacagagttgtcatggtatgctgtgctttgcttctgtgacattagcaagccagtatctagaaagacagaagttggtcagtctgttcgtctcccttcaggcccacttttacacctgtccttagaaaaggaagaaaaccaaagactcatagtctttaggattgtgggtcaatacataagaaatgtgcacttggtaaaaccccaacctaccatcaaaaatgactgtgatccacgttccccctgcaaggctaccttcttcaggttcaatatgtaaactcaggtgacgtactgtaagtaagtgaaaaaaaacattggttttgaaggtcagattcaaaccactaccttctgcaatattttaagcaatatttaacctgcctcagaatcaccagaaaggcttgattaagcacaggtggttgcaccacatccccagagtttctggttccgtaggtctggggcaggcccaagaatctacatttctaaccaggtgctgctggtgtgggaaacacatcatcagaagccccattttaaggaaaattttgacaaattcttcttatcttagacattcaaaaaccctgcactcatcaggacaattctgaatttctacttcctttggaaagagcctcaaggacatatttgggtcctaatcaaacccatactgtctctctctgctctctttcccactctttaatcaggtggccatatttccctgtaaagatcatcaatcatttccagtcctggagagaaaaaaggacttccattaggttggtgcaaaagcaattgctgttttgcattccttttaatggcaaaaccgcgattacttttgcaccaacctaatagaagctgttcctatttcaattctcctgctcaatatactgcttaatatactagttttccctcatgatcagaatgacttcccaaatgaatacaaaattatctagattcttgccttgcctgcttagagagggggtgaagcatggatcattgctggaatttccttttgtttaaaaaaaaaaaaggcagtatagaatttatatactaggctagattggattctcctgtatagatcaccagctaagcatgggccttaatctatccctccatctttgaagatgttcctggacaagtcttgatgaaggaaaggccaagttaaggaagccagcaaaaatcatgcagctgctcagtgaggtaataaacaaggaaagtgttaccgacagaattatttatagtttctttagaagaaactgtgtctagcccaggacttccctgtacagttattctcatgatgcacttcacatctgaaggtggtggggaaccacgtcacattagcacaaccatttatggcagccccagccagactagaccatcttccaaagatgattagatacttctatctaaagaagccccaaaacaaaggccataaaaagatacagaggataaccaaattcgcagagaaaattgaacagatgatttgagataatacaagcaatctaatgattatgacaagttaatctctttgggaaagtccgacagcaaaatctaaaaagaattacatcacatagcccaaaaggaattataaaagaaaggttataagttattattaaaagctctgcactacaacaataatcttcactgaccattaaaaattgaagtatatagtcataacatttcagtatataacctcagctgttaaacagaaaataaaaacaattattcaacatataatttaaacccaaaagcaaataccttaacacctgctctgaaaacagtatttttaactcaattttttgattggcaagttaaaaatgcatatatttatggtatacaaccaaaatattactttaagtttcaataatagttctcaaggtaacctattgtgttcttacctataattccttcaaaacacattctactgacctgccaaaagtagtacttcaatactcatcagagagatcagccaggcagtcattctgtccacttaaatcaatactcttaagattgctcagacattaaaagcattttcagttttgattggagcagcatagcttttgtgctttataaaaacaaaaaaagcaaaaaaaaattatcattttgtttacatacgattattttgctgttctgaaacctgggaaattaaggagatgagataaacatggccttagtgtcttcaaatggagccaccatttttccaagctcaggagaaaaggatcatctgagaaccttgcataaaatcatccccactctgccctccttgtcccaccaacttattttaagctggataaataataacctctttcattaactcattattgaacagaagctgagttttaaaaagaattctagaaattaaaattctagttcgtgatagggtgaagtctgttttgctttgccctgtgctggcgtccagctttccctcgtgctgctctccagtttgaaccctacactgcagccacacgccgttctcaccgtcactcagacaagccttccacacatcagcctctgccttggcccctgctggtcccttcctggatgccctcaactctctccgtggcctcaggagatcctggcgcaccttcgtggtgctgctcaggagcccctcctcagctgattctttcctccgccattccagtgctcaccaccttccccctgaacctctaacttccgtgctgtagagcctagaccagataatgtggcacacataggcctcttcttccagacggcacgttccttgaagagacccaggaaccagtcttctatttccacagccttcctagtgtgaaagtgtgaaggtcccacacagcgctcagtacattggagtggatgaagacatatttgaataccctaaatctgggtttacctaatctgagatgaacagctttcactctcatgcctgctctaaggaaagtgctgagctgctctccagcacctcatggcagagggcatcgacaaaatcctcttaaaaatagtgcctctgaaattttctgaaagtttgaaaattacagaattaaacacccacatgtactactaaatacacgtttaatatatatttaattatgtttatgtttattacatataaatatataaatatatttaatatatatatacatacctacatacacacacacacatacacacacacaaagtgtgtgtgtatgtgtgtgtgtgtggcagggtctcattctgtcatttgggctggagtgcagtggcatgatgtcagttcactgcaacctccatctcccaggttcaagtgattcttatgcctcagcctcctgagtagctgggattacaggtgtgcgccaccacacccggctaatttttgaattttttgtagagacaggttttcaccatgatagccagactggtcttgaactcctggcctcaagtgatctccctgcctcagcctcccaaagtgctgggattacaggcatgaaccaccacacctggccatttaatttatatttttaagaaaacactgagattagcagaagtagttacatcatttctgaaaatataaaagctacaatatactccccccctcaaaaaaaaaatctgcaaaaactttgcaataaactcaccttacgggcatgttctgattgagacagctggaaatctataatcatttctatttaattcaacactgcaaacatttattgtatgcccactacgtgctaagcactatactaaaagttgggaaaacaaacaatctatgtacctgcccccgagtcattaccagatagggtaagtgtggaggctacttggatttaagaaaggaattctagtattttcaagtggattcagcaagtgttccttttcgttgcaaaattcccaaacttttacgtctatttgaaatagaattcaacttataaatatacaactttcagaatacatctaccacatagggaaaagtacccaagcgtatttgctgcttagtccaaaagcatgagatctgacttgcttgttacacagacaaaatatactcagcacaggagagtctattttcaatctggctacgtgattttaacatttcttcttaatgcctactcccaagctcagaacaatagaaataaacattcgcacactggttttcttaaaaccctacatttggaactgcatctttttcatgtcaattataaatgtaattttttattagtctatccactaattcttcctaaaaataaactcagactctctttatttctcataactaaaatttttcaaccacagaggagagctgtgtgcatttatttagtcatgtttttgttctcctctctctctctcctctctctgctctcactccctcttcccttcttcctcccttccctctcagcttctcctttgggacatcgagggacaaagttgcaaggcactactatagatctcccatttcttccttttgttcaccagaacgttaacaagagatacaacacctagaaaacagagagcagagacttttctggatcaaacagtaccttttttttctgtttctgtctccttgtgactcaagggagaaatgatcctttctttctaagtgatcttatttctctctgtcaagaatccgtggacatgttatctggttagagctcagcctgcagccaccacgcaggtaactcactcacgttagactataactcacctaactcgtttgtgtcccagccaaatgt

SEQ ID NO: 241 - DNA, 60636 bp, Homo sapiens
tcaattcacaaaggtttattttgatgatttataaaagaaacattgccatagcaatttaaagctatttacaaatttaaaaataaatgtacataaatgtattcacatcacattaaacagttttaaaatattacacgtagtgttgaacacaaaacataaactaagttttaagccacataggtgttctgaaagcatgctcaacaaccacagccactggaggatggtccactggaaaaatatgatttcaggaaccagaagtaaagatgattaccctagtctcaggtgatgtggcctttaaaagtcactttaactttaaactgcaacacaaacttagatgaagacagactgaacaaacagtgagaattaattaaaaaaaaaattctcgtgtagcttaaaaacatagaacaggctgggcacagtggctcatgcctgtagtctcaacactttgtgaggccgagacaggaggatcgcttgaagccaggagttcaaaaccagcctgggcgacaaaacgagaccccatctctacaaaatacaaacgaacaaaacacagcacatagaaatttatactgtgatccatgtgagagtagatttaaaccaggatgatcttatttgtgattgactgggcatcgcacttttctttctttattctttttttttttttgagttggagtctcgctccatcgcccaggctggagtgcagtggcgtgatcttggttcactgcaacttccacctcccaggttcaagtgattctcctacctcagcctcctgagtatctgggattacaggcgcccgtcaccacgcccagctaattttttgtatttttagtagagatggggtttcaccatgctggccaggctggtctcgaactcctgatctcatgattcgcccacctcagccccccaaagtgctgggattacaggcatgagccaccgtgcccggccgcttcgcatttttcttttgcaggttgcatgccagccaatattcctctgtgctgggaagggaaagtttgaggatgtatcaagaccatagcagtggatctcactgctcttgcctactcagggctttatctacacattgatagcccctcagaggaaaggcaccagccgaagagtcgacactggctctgggcttggatgctgcctctgataaacgctgggcactctgaccctgaagccagggagggagtgcttggcagctgcctgggcacactcccctcagtccagttgccaggcgaaattatacagtggatggcagctccacagagatgctaaagtttgaggtctaagtgtcagagagagctgacaatttttatgaggaaagtgaacaacaacaggtgtttatcagtacctgagaattatcatctagtttaattaagcaaaggtatcaggaggtctgtttcagctcattccctttagtatggccctaaaaaatcaacagaactgtcctacttcatgttgcccgactagcaggcaggtatgtgaacctaaagtagaagtcctagcttacatattattcataattaaacacagttcattttattattctggcaactagtgatatttcatgattataggccttaaaaatctaatacaagtacaattaaaaaaagacatagaatgcttacacaatacagaaggcactttgaggttacatgataaataaaaatacattaatagaggcaggattatttattggttccttcagtgtctgtgtccatggtgatcattgagagcccagttttgtacttcacctttggcgaatagtgtaaagaaaatggcaccaaaaacattaatagcagcagcaatatagaacacggtttgccattctccaacagtgttctataaaggaagacaaaaaatgcaagtgaaataaaattttgtgtgtagttcacttcattaaaaagatagtgtcacaagagtgttaaaacagccacattattcataaaagcctcatccttgaaacaacccaaatgtccaccagcagtaggatagtggtatatttgttcaacgtaatacaatacagcaatgagaatgggctacaacatcataaatacagctcacaaacaaaatatgaagcaaaagaagccagacaaaaaaggtacatactaaattattccatttatataaagcccaaagtcagaccatactaatctatggggttaaaagttgggagagtggttccacttggtgagggtgaaggaaaaataggaggaaatggtacctggggtcttactgagggaggtaatattctgtttcttgattgggtgctggttacacagatgtattaactttgtggaaattcatctagctgcacactttagattagtgcatttatttatttttgtttttatttttgagacagagtctcactctgtcacccgggctggagtgcagtggcgcaatctcggctcactgcagcctccactttctgggctgaggcaatcctcccaactcagccttccaaggagctgggattagaggtgcatgctaccatgcctggctaattttctttgtgtgtgtatatatatgtatatatatacgtatatatatacatatacatatatatatatatacgtatatatatacatatacatatatatatatatttttggtagagatggggtttcgccatgtttcccaggctggtcttgaactcctgggctcaagtgatccactcgcctcagcctcccgcagtgatggtactacaggtgtgagccaccacgcctggcctggatttgtgcatttaaaaaaagttatacttcaataaaaagtttactgaagatagatagatatacttcaataaaaagtgtactggcatgtccctgaatcatgcctaacactaactaacactaagaaagtcttatgcctgtgcacggtctcctgggttctcaggtgaaaggtgtcaggtggatcaagtaaatactgttaagatgaactcaagttcagctttgaggatctgtgacatcagagagaggcctggcaagtataaaagatcttgaatggcatacaaagcaggatataacatgggatctgtcagtaagacaactgttcagtgtataaccctgtggcataaaaatatcagacagttatctaaatttctgggtcatgtgactacctttaacaaccattttttggattttttcaatttcagtctaaccagagtggtgactacatttgcagcattaactaagaaacacacggccgggcgtggtggatcacgcctgtaatcccagcactttgggaggccgaggcgggcggatcatgaggtcaggagatcgagaccatcctggctaacatggtgaaaccccgtctttactaaaaaaataaaaaattagccgggcgtggtggctggtgcctgtagtcccagctactcgggaggctgaggcaggagaatggcgtgaacctgggaggtggagcttgcagtgaggctgagatcgctccactgcactccagcttgggcaacagagcaagactccctctcaaaaacaaaacaaaacaaaactggttgggcgtggtggctcatgcttgtaatcccagcactttgggaggctgaggtgggtggatcacccgaggtcaggagttcaagaccagcctggccaacatggcgagaccctgtccctactaaaaatacaaaaattagctgggcgtggtggcaggctcctgtaatcccagctactcgggaggctgaggcaggagaattgcttgaacctgggaggcggaggttgcagtgagctgagatcatgccattgcactccagcctggggaacaagagtgaaactccgtctcaaaaataaataaataaataaaccaggccaggcgtggtggcttacgcctgtaatcctagcactttgggaggccatggtgggcggatcacgaggtcaggagatggagactgtcctggctaacaaggtgaaaccccgtctctactaaaaagacaaaaaattagccaggcgtggtggtgggcacctgtaatcccagctacttgggaggctgaggcaggagaatggcgtgaacccgggaggcggagtttgcagtgagccaagatcgtgccactgcactccagcctgggcaacagagtgagactccgtctcaaaaacaaaacaaaacaaaacaaaaaaaaccaagcaggccaggcatggcggctcatgcctgtaatcccagcactttgggaggccgaggtaggtggctaccttgagccctggagtttgagaccagcctgggcaaggtggtgaaaccccatctttacaagaagtaggaaaattagctggacatggtagtgtacatctgtagtcccagctacttggggggctgaggtaggaagatcacctgagcctggggaggttgaggctgcagtgagccatgattgcgccactgcactctagcctgggcgatggagaccctgtctcaaaaaacaaagaaacaaacaaacaaacaaaaaacccaaacaaacaagcagtagaactagcaatgaggaagtgaaagagaaggcactgggaagccagtatgaggtcatttatttgggaaaaaaggagaaacatgaagaaagaaacaccctgtggtggctatacttgtctgagatgagtgcattttaatgaaaaaaaatcttagatactcatcttaaattctgctgaggaatcagtcaataattacatcttataccagaaagaaatgtttgaaacagcttcttaggattactaagacaaagctgccctgtgtggtctctgggacaaaataatacttcagtgttatctgaaggcaatgagtgaacttaaaatcaatcgttgtactacaagtctcacacagctcctagtttgttttttaacaaaaattccaccagtttttagagaatactgttttgtttataacaacattgaacctcagacacactttgaattttaattattgcattatttatttatatgctgactcattccacaaagtttttgaggcagtgctcaaagtaagaaattacaggctgggcgcggtggctcatgcctgatatcccagcactttgggaggctgaggcgggtggatcatttgaggtcagaagttcgagaccagcctggccaacatggtgaaaccccatctgtactaaaaattcaaaaattagccgggtgtggtggcacgtgcctgtagtcctagctacttgggaggctgaggcaggagaattgtttgaacctgggaggcggaggttgcagtgagctgagatcacgccactgccctccaacctgggggacgagtgagacttcatctcaaaaagaagaaagaaattacaattgtgaaggtaagtgtgtgcttttcctttttaaaaataatatactttagagttttatttggccgggtgcagtggctcactcctgtaatcccagcactttgggaggccgagatgggcggatcacctgagttccaaaccagcctgaccaacatggagaagctccgtctctattaaaaatacaaaattagctgggcgtggtggcacatgcctgtaatcccagctattcgggaggctgaggcaggaaaatcgccggaacccgggaggcaaaggttgtggtgagctgagattgcgccattgtactccagcctgggcaacaagagcgaaactccgtctcaaaaaaaaaaaccaaaaaacacacacacacacaaacaaaaaacaaaaattagcagggcatggtggtgagtgcctgtagttccagctacctgggaggctgaggcaggagaatcgcttgaacttgggaggcagaggttgcagtgagctgagactgcaccactgtactccagactgggcaacggagtgcgaaacttattttattttgtttatttttttatttttattttttatttattttatttttttgagacagggtctcccgctctcacccaggctggagtgcagaggcatgatcatagctcactgcagcctcaaaaccctgggcttatgcatccacctgcctcagcctcctaagtagctgggactacaggtacaaaccacacccagctaaaacagtgatatccttttaatagcattaaacaaatgctgtaacatatcccaaatcaagcgcagttcccacttgtaaacatacaagactgtaattcaggaatccatatttccctagcagaagtgctggcattatcagtaagtgaaatgaacacatggtagtgagctgacttaggttctggtgttgccaccctgctccatgaggacaaggttaaacattttggacatgtccatattgagacacagaactttagaaaaagcatttctacaacattcctttttattaagtgagaggaaatagtaacaggtaccgtgtcacttaaggaattagaaatggtagatgtggagaagaagtaggaacactatctgtcggatatatgtctgaaatcagtatatttggtaataagaaagtctgtaagtatgtcctgaaattctttttttttttttgagacggagtcttgctctgttgccagactggagtgcagtggtgatgttggcttactgcaacctccgcctcctgggtttgagcgattcttgtgcctcagcctcctgagtagctgggactacaggcacctgccaccacaccggctaatttttgtatttttagtagagacggggtttcaccatgttggtgaggctggtattgaactcctgacctcgtgatccacctgcctcggcctcccaaagtgctgggattacaggcatgagccactgcacccggccaatatcacaacttttaactacttgtgtggtttcagctacagtgtcttcatttgacttagttcaattgttttgtctaaaatccaaaaactgttctttgaaaatatactttcccatccattaaggcatttagctttttgttgctaaaaagaatttcataagaacatttagaattttaaacttaattaaaatacactgaactttgacacagatgtgcagctccaaaacctttccagtttacaagtaaattatctacttacatcaggggtcagacttttagcaatgacgggcccaaccattcctggaatagtggcaaatgtatttgtgatgcccaggaggataccagcatacctgtagaaacattttcatagacgtttattattgtgatacacatttaaacagcttcattctttccttcttttttttttttttttttgagacagagtctcactctgtggcccaggcttgagggcagtgggatgatctcagctcactgcagcctctgcctcccgggttcaagcatgccttagcctcctgagtagcggggactacaggcatccaccatcatgctgggctagttttgtatttttagtagagccggtgtctcaccatgttggccaggctgctctcgagctcctgacctcaagtgatctgcctgcctcggcctcccaaagtgctgggatttcaagtatgagccacagcgcctggctgcttctttcaatagacagctattctgctccaggttgtgttcttgtgaaattttatgtctaaataaaatgtcttattgcaatgggattttatattcagctggtgaaaaacttgcatttcaatagttaagtagcattttaacattaacattaggcccggccgccaccccgtctgggaagtgaggagcgtctctgcctggccgcccatcgtctgggaagtgaggagaccctctgcctggatgcccagtctggaaagtgaggagcgtctctgcccggccgccatcccatctaggaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgcctggccccgaccccgtctggaaggtgaggagcgtctctgcccagccgccccgtctgagaagtgaggagcccctccgcccggcagccgccccgtctgagaagtgaggagcccctctgcccggcagccaccccgtctgggaagtgaggagcgtctccgcccggcagccgccccgtccgggagggaggtgggggggtcagccccgcgcccggccagccgccccgtccgggagggaggtgggggggtcagcaccccgcctggccagccgccccgtccgggagggaggtgggggggtcagccccccgcccggccagccaacccgtccgggaggtgaggggagcctctgcccggccgcccctactgggaagtgaggagccctgctgcccggccagccgccccgtccgggagggaggtgggggggggtcagccccccgcccagccagatgccccgtccaggagggaggtggggtggtcagccccccgcccggccagccgccccgtccgggaggtgaggggcgcctctgcccagccgcccctactgagaagtgaggagcccctctgcccggccagccgctccgtccgggagggaggtgggggggtcagccccctgcccggccagccgccccgtccgggaggtgaggggcgcctctgcccggccgcccctactgggaagtgaggagcccctctgcccggccaccaccccgtctgggaggtgtacccaacagctcattgagaacgggctgggatgacaatggcggttttgtggaatagaaaggggggaaaggtggggaaaagattgagaaatcggatggttgccgtgtctgtgtagaaagaagtagacatgggagacttttcattttgttctgtactaagatacattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaacgccgcagggtcctctgcctaggaaaaccagagacctttgttcacttgtttatctgccgaccttccctccactattgtcctatgaccctgccaaatccccctctgtgagaaacacccaagaatgatcaataaaaaaaataaaaattaacaacaacaacaacaacaaaaaacattaacattagaggaaggctgggcgcggtggctcacgcttgtaatcccagcactttgggaggccgaggcgggtggatcacgaggtcaggagatcgagaccatgctggctaacatggtgaaaccccgtctctaccaaaaatacaaaaaaattagccggccgtgatggcaggcgcctctagtcccagctactcgggaggctgaggcaggagaatggcgtgaacctgggaggcggagcttgcagtgagcagagatcgcgccactgcactccagcctggccgacagagcgagactccgtctcaaaaaaaaaaaaaaaaaaattacatacaggaacacagccatggaaataacccctttttatagtgatataggaaagttctgagatatcattttcatacagaaagcttagcatgtctagcttaaagttttttaagttaaaaaaaatttctttcctgatttgaaaattcaattgtaattaatttttgaaaattaatacgaaaaaagaaaaaaataatgaagtaaaattacctataattcttccccatagagatgatcaacattaacattttcataaatatcctatttttttctgtctgtatatatttctagtatgttattatagacgtgagatcatatcaaacataaaatttgcttgttccattaattacatttttttttttgagacggagtctctgtcgctcaggctggagtacagtggcgcgatctcagctcattgcaacctccgcctcctaggttcaagtgattcttctgcttcagcctcccaagtagctgggactatacacgcatgccatgtaggtcaggctggtcttgaactcctgatctcaggtgatccacctgcctcagcctcccaaattgccaaattgctgggattacaggcgtgagccactgcacctggcccgataattcatttttaaaattgctgcctctttttttttttttttttgagacagagtttcactcttgttgcccagactggagtgcaatggtgtgatcttggctcattacaacttccacctccccagttcaagtgattctccttcctcagcctcctgagtagctgggattacaggcatgcaccaccatacctgggtaattttgtatttttagtagaaacggggtttcaccacgttggttaggctggtctcaaactcctgacctcaggtgatccacctgccccagcctcccatagtgctgggattacaggagcgagccactgcgcctggcctaaaattgctgtccctttactaggatgtttgtcctgtatatattcatgaattctggactttgaagattgtatctcttaggtatcatttcacataatcttatacctcctgtatttcctgtacactgatagtttctagactctagatcctagggggttcattagatttaggtttaatgtttttggtaaaaaacaaaaacaaaaacaaaaaacaaaaaaaaaacacttaaaggagaaggaggagttcagttaaaaaaagtgctgcttaactaattcagttatgtataaagatcacaaagttttatgttcaaaacttgtgcatacacacagcactataacaaaaccatgaagtacagatctttttggctcatcccctttaggggtgtatctaaattaaccaagcttggcagagcctctcttttttttttttctttttaaaccattaacaccttggcagtaagaggagtcaactgcaatgttgccagcctttccagtgacagatattaagtgcagacgaatgccatgaaattctaaatgtcagcaacaagaagctcattcaagtacttatatttcacttggccaggacaggccatgaaagattgatgaccacttggaagaaaacaagttgtatggactcagtctggattctgtgctgttggagtactattggaattaatagctgaaaatctatctaattcccatgaattcgggcaacaaaattaccatagaaaaatctctattttggggccgggtgtggtggtgcatgcctgtaatcccagcattttgggaggctgaggtgggagaattgcttgagcccaggagtttgagactagcctgggcaacatggtgaaaccctctctctacaaaaactaaaaaaacacacaaaattagctgggtgtgttggctcaggctgtagacccgctcgctactcaggaggctgaggtggaggattgcaggaggattgcttgcgactgcagtgagccgtggtcttgctgctgtactccagcctgggtgacagggtgtgactctgcctcaaaagataataaatacattgataacataaaatctctatttcagtctatagaagtaaaggcctataaaatccaagtacacatttatatgttaataggaatattatttattggaaaaccttgtatctgtttactgactatgtattggaaaacctgatatcagacatgtttataagggttttatatatcatattatatcattttaattataaaatcaaccccatgaggaaggattatcttcattttatttttaaaattttaaaattttgttaagttttttagaggtacgatcttgctatattgcccaggcaggtcttgaactgctgggcccaaacgatcctcccaccttggccttccgaagtcctgggattacaggcgagagccactgcacccagctggattatcttcattttatagatgaagaaaaaccataaaatgtcacccaatttgtctgattctgaatcagtacttaatattataatgttataatctacaatgctaccttgttaaaaaaaacaaaacacagtaatcactgaacccaatctgtaggaaagataaattttctcatgcttcatttttcaccacaagccctggtgttgaacttgtttatggcttgtttatggtcctcaagtgcctctgttttaactagtagcgtattacactgaatgggccctcagttgttaccacaacaaaaagcaactatgaaaaacctaagatatgtaatccccaataagatatgtagccaagactcctgcaactagaaataactgatgtgctttgaatgaagaaattccagttggaaaagaaaaactaaaaagctcatctgaagagctgaatcaaaatataagaaagttatcctttgagctagaactgcaaggtttaaacacacacacacacacacacacacacacacacacacactaagggagataaataattttgactttgggctgggcatggtggctcacgcctgtaatcctagcactttgggaggttgaggctggcggatcacctgaggtcgggagttcgagaccagcatgaccaacatggagaaactccctctctactaaaaatacaaaattagcagggtgtggtggcacatgcctgtaatcccagctacttgggaggctgaggcaggagaatcacttgaacccaagaggcagaggttgcggtgagctgagattgcaccattgcactccagcctgggcaacaagagtgaaactccatctcaaaaacaaaacaaaacaaaaaacaaataataataattttgaatttgatgagatttatttatttatttatttatttaattttttgagactgagtctcactctgcagcccaggctggagtgcagtagcacaatctctgctcactgcaacctccaactcctgggttcaagcaattctcatgcctcagcctcctgagtcagtgggattatagtcgcccgccaccacacctggttaatttttgtatttttagtagagatggggtttcaccatgttggtcaggctggtctggagctcctaacctcaaacgatccaaccgcctcagcctcccaaagtgctgggattacaggcatgagccacctcaccgggcctacttacatttggaatagttgtgtctcagtcagctgagaaccagtacagcagtcctcattatctgaggcacaaaggcacttgcttaccatcctcccaactgctacaactatttgctggcatcatttatgttactaaacctgtttagcttcttatgatatctagataaatgtctttttcggcttataagactcataaaatttcagggttggacctgggtctttaagatgtagacttcaaccacccacctgatgcttgaagctcaggcacaggatccccctgctgcctgtccagcattatacttcatgacatgacccaccatcatccaggccagcttaagcttatacagatgccagcaggaatcatgttactttcatgtttgtgtcttcaacatctggtacagtgcctggcacagtgtttctcaaatgactagatccgttaatgagcatgctattacactgaaatttagtagtgacaaatttatctaattgtacatccaattcatctttctccaccttgtccaaaacggcatctatcataggaggcctggctgaagtcctgacatatcaaatctactatattttctttattctattaggctaaaaattatgttgagaagttagactgttttgccattttggctcttagtgacccaatggtggctctttagtggtcagcattttcctttctgaaagcacaccaatcatcactttaatattttacttggattgatctgtgaccctggtcaccacacctgactcaaagttagccagaaaataattacatctattgcattatatgcaaatacctttattgcattatgagcaaagtgttctgtgcgtgttctatttaatcttcacaacgatcttataaggtaggtaccatggatatttggttttctttttcttcagcatctattttcatcttttgacaatagcactattttttttttttttgagatggagtttcactcttgtcacccaggctagagtgcaattgctcactgcaacctccacctcccaggttcaagtgattttctgcctcatccttccaagtagctgggattacaggtcctaccaccccacctggctaattttatatttttagtagagacagagtttcaccatgttggccaggctggtcttgaactcctgacctcaggtgatctgcccaccttggtctcccaaagtgccgggattacaggcatgagccattacacccggccgaccatagctccaatttttatccgatgatccaattttctttcattgctagttcaagagagcagggggggccctcatcagattccagagattctaataagacttcaggaacctgatgaatcctaagctacctttcagatttattaaatggtgtgggtgacttaccaccttctggctggatggctgctgaaccaattttatgttccttataatttttttttttttttttttgagatggagtctcactttgtcacccaggctggagcacagtggcacaatcttggctcacagcaacctctgcctcccgggttcaagcgattctcctgcctcagcctcctgagaagctgagactacaggtgtgtgccatcacaccctgctaatttttgtatttttagtagagatggggtttcaccatgttggccaggctgatctcgaactcctgacctcaggtgatccacccgcctcagcctcccaaagtgttgggattacaggcgtgaactaccgtgcccggctcaaaatgactcatgtttatttacatcttcatgtgttataatggatgttaccgatggattcctcagcatccattcccactccccacccccatctgtgtagcaatagtgatgtctgaggggcactgaccctttgacttctaacttttggggtaggtgctgattgtcctaaagtcacatgatattctcttggccattggggttggttcatgtgactcagtttgggtcaaccaaaatgaagcccaggacttatttccatggtggagagaggaaaagatccttttctttctgcttgatgtgaatgaagaagcatgtagtcctgattgttgctggcaatcatttcattgtgtgattttataagcagacccagtcttaggacaaaactactactgtaaaagacagagagtgagaaagaaacaatctgtggtgatattagtaggcagctggatatcaactcttgcctgaagcctattatttctggatacaattaagtgaatcaatagattatgctgtttagcccagtttaaattagaatttctatacttcaactaaaaacatcctaagcgataacatagcctagaactatttcttgccaaaactctcaattcccatatccctttgactattcgtcaatcctaggcttgacaaaacctcaagtcttggccaggtgctgtggcccacgcctgtaatcctagcacttcggggggctgaggcgggaagattacttgaggccaggagactgagaccaccctgggcaagatagggagaccccatctctacaaaatattttttgaaaaattaaccaggcatggtgatgtatgcctgcagtcccagcgactcaggaggctgagcaggaaggattacttgatcccaggagttcaaggccacagtgaactacagtggcgtcactgcactctagcctgggtgacagagtgcagcttatcttagagtatttattgaagagataggagactgaggattcatagaaatcagaagattctgtaggagtccaggtgtgaagattttgaggtagtgaaaagagggtaagagtccatctgtcttttctccaaaataaatttatatctattatttttacaaataaagtgtattaaaacttttgggttaaaatatttacatagctcccttatttaccttgtcagctggcacaaaatggttttagaagtatgtggctcaaagaatatttccagagaggtagctgtagaaagaattttgggcttaaaagtaaaaattttaggttcaagttttggctctatcatttattatattagctgtgtgctgcaagataaatcacttaacttctcttaagtttctttagcgttcaaatagggcaaaaatacttacttcaaaggaatgctttaagggtaaaatggatagtgtttatgaaagtgatgtgtaaactatcaagggctacacaaatatatttgcacataggtaatatagttagacaaatcaattgggtctactctttcacattcattcatctgacaaaatgcctactacatgccaagtgccatggagagccctgaggacaataagggagtttctgccttcacagagttcctagtctagttgggtgaacagacacagtaatgagttattgcaatgttctaatgagagcactgtggacagaggtgatgatagttaaaagtttaaatttaaaaacaacttcctgctttaattattgtgtaaattaaaatcctgttaagaatttaaagtcattcctatagtagtcaaatccatagaggcagaaagtagaatgttggttgccagggcctgggaggaaggagaaatgggagattgtgtttaacgggtacagtttctgttgagaagatgaaattgctctagagattgttggtggtgctagttatgaaacaatgtgaatacttaatgccacagaactgcatacttaaaatggtaagttttatatcatatctattttatcaggtttttttttttttagatggagtcttgctcttgttgcccaggctgaagtgcaatgatgcgatctcagctcactgcaacctctgcctcctgggttcaagcgattctcctgcctcagcctcctaagtagctgggattacaggtgcccgccatcatgcctggctaatttttgtatttttagtagagatagggcttcgccatgttggccaggctggtctcaaactcctgacctcaggttatctgcctgccttggcctcccaaagtgctgggattacaggtgtgagtcaccgcctctggccttttatcaggatttttaaaaatataatttaaagtcaatcacagcaaatctttatattagtactcacgaaggagcaatatccagatggttgatgctaaatccagaagagcaaaagcctcccagtgttgttgatatagttaggaaagcaacggccaaagaataatcacagccaatgaagccagcagctaccaggaatactgcaggtccaatcattcctggagttaaaaagttataaaagggaaaaaacacccagcattaatatttgctctaccttaatatggtataaatctgaaatttgaaattgctgccacctactgtagaaacactatattgcctggaagactaacaaatttcatgagaaaaaaaaaatgctggaaaacatgggcgtaatacaactaatatactataaaaggaaaatctcattatgcaatgttattaaatctacatgtggccaaaactcagctaaaattccatggtgttagagaagaacaagacaagaacaacttaaaaatatgtttctagagagaagcaatagctgacacagaatgtggtttaaaatacatataaccaaaggagataaactgaataataaactctgttggatgaggttagaataatactccatcttgcctgggtgtggcagctcacacctgtaatcccagcacgttaggaggctgaggcgggagaatcacttgaggccaggagtttgaggccagcctgggcaacacagcaagaccctgtctctacgaaatattaaaaacaaaattcgccaggcatggtggtgcacacctgtagtcctggctgctcaggaggctgaggtgggaggattgcttgagcccagaagttcaaggttacagtgagctatgatggcaccactgcactccagcctgggttgtcagagcaagaccttgtttcttaaaaagattttttaaaatctctgtcttcattctctctctcttttttttgagctggagtctcactctgtcacccaggctggagtgcagtggcgtgatctgggctcactgccacctctgcctcctaggttcaagtgattctcctgcctcagcctcctgaatagctggaattacaggcctgggccaccatacccagctaatttttgtatttttagtagagatggggtttcgccatgttggccaggccgttctcgaactcctgacctcaagcgatccacccaccttgcctcccaaagtgctgggattacaggtgtgagccaccatgcccggccttggttttttttttttctgccccacctaatatgcaggaatcctccctattattaacaactgataagaatacacattggtcattacaggcagttaagcgtaaaatatgagaagagacttaatgagtgggctgtcagtttttctgtgtctacagcagtgctatccaatagctctctgtgatgatggaaatgttgtatttgtatatactgcaactgaggaactttaaaaaaagttcaattacatttatttacttatttatttattttcttgtttttttgagacagggtctcactgtcgtcaggctggagtgcagtggtgcgatcatggctcactgcagccttgacttcccaggctcaagtgatcctctgccttggcttcctgagtagctgggactacaggtgcacgccaccatgtctgatttaatttaatttcattacttttatttatttattttgaaatagggtcgcattctgttacccaggctggagtgcagtggcacaatctgagctcactgcaacctctgcctcccaggtgtaagcaagtcttgtgcctcagcctcctgagtagctgggattaaaggcatgtgccaccatgcctggctaattttttttttttcactctttttgcccagactggagtgcagtggcgaaatcttggctcactgcaacctctgcctcccaggttcaagcaattctcctgcctcggcctcctgaatagctgggacagccacacaccaccacgccaagctaatctttgtattagagatggggtttcaccatgttggccagcctggttttgagctcctgacctcaagtatctgcctgcctccgcctctgcctcccaaagtgctgggattacaggcaacagccaccgagcccagccagggtctttttataatgtaattactgaagtatagtcactgagacttccagggtctctactggagacttttaaaaagttaaatgattgtcttagacagttttatttctacgtacatttttttctaactatttttagagatagggtattgctctgttgcctaggttggagtgcagtgttgtgatcatagctctctgcagcctcaaacaactaggctcaagagattttctcaccttagcctctggagtagctgggactacagatacataccatcatgcctaactgattagatagttttaaaagttacctttctaggccaggcacagtggctcacgcctgtaattccagcactttgaaaggctgaggtgggaggatcgcttgagcccaggaatttgtgactaacctgagcaacatggtaaaaccatgtctctacaaaaaatcaaaaataattagctgggtgctgtggcgtgacctgtagtcccagctgctcaggagactgaggtgggagaattacttgtgcctagaaggttgaggctgcagtgagccatggttgtccatcctggccaacggagcaagaccctgtctcaaaaaaaaaaaaaattacctttctgaaagcagagtctgaaacacatgattatttatgggttctttgagttctttgatttatagctccttatttgatataataatgctagtaaatatttttggattgaaacttaaaatgcattcacttagaaaagggatggaggcttaaaaatactttgattacatcttgtctaaagttgatataaaaatcttcattgcaaagtctgagctgaaagcacagtgatatataaaattgtgagggatgatgtttggcacagcaagccattttaaaaataattataagccatggtggagataaatcttttataaattttttttttttgagacaggatctcactctgttgcccaggctggagtgcagtggcgcgatttcagctcactgcaacctctgcctcctgggttcaagcaattctcctgcttcagcctcccaggtagctgggattacaggcacttgccaccacgcccagctaatttttgtatttttagtagacagggtttcaccatgttggtcagactggtcttgaactcctgaccttgtgatctgctcacctcagcctcccaaagtgctaggattacaggcataagccactgcgcccagtgaatattataaatcttaatcctcaaaatgtatgattcaaaaagaaacatattgtaaagaaatgcacttaaatgcatcatagtgttttgttatgtgaacaaaataaaagactaatattatcatttttattttgtcttgaactgttgtgatattgtgattttaaaaaatatggctgggggctgggtgtggtggctcacacctgtaatcctagcactttgggaggctgaagcagcaggattgctgaaggccaggagttcaaggccaatgtgggcaataaagcgagaccttgtcccattaaagaaagaaattaaacaaaatggctggggctgggtgtggtgcctcactcctgtagtcccagcactttgggaggccaaggcgggcagatgacttgagttcaggagttaaagaccagcctggacaacgtggtgaaaccccgtcttcagtaaaaattaaaaaattagctgggtatggtggtgtgtgcctgtagtcctagctactcaggaggctgaggtgggaggatcacctgaggctgaggaggttgaggctgcagtgagtcaagatcatgccaccacactccagcctgggctaagagtgagcccctgtctcaagaaaaaaaataagaaaagaaatatggccagtgtggtggctcatgtctgtaatcccaacattttgggatgctgaggcaggaagatcacttgaggccaggaattcaagaccagacggggcaacatagcaagaccccatttctattaaaaaattgttttaaaaaagaaatatatatttggtctctgcccccggttttttggcacacagctcctaaaacttttggaatttctggagtggtaacagtgtcttttgtatgctaatgagacaattggtggctgggggtccccatacagcttcaggatggtggctggattagaggtctgggacttttggcaccacccccaaactccagagaggggagaggggctgaaggttgagccagtcaccaatggccaatgatttaatcaatcatacacatttaacgaagtctccatacaaactcaaagggacagggtttggatgaacttttgcggtcggggttcttggagggtggtgttccaggagagggcatgaaaactccctacccggtcccacatatgttgccctatgcagcttttccatctggctgttcatctatatcctttgcaataccctttataataagtgggtaaacataaaataaagtgtttctctgagttctctgagatgctctagcagattaactgaacctgacaagacagtcatgggaaccctgatttatagccggtcagtcagaagcagaggtcacaagctgggacttgtgattggtatccgaagtaggggggcgatcttgtggaactgagccctcaacctataggatctgatgctaccgccagctggacagtgtcagaactgaattacaggatacctagctggtgtccgctgcagaactggttatgtgtaggcagaaatccccacaaacattttggtgattagagcgaggtgttctgtgttgagtattgtgttaactgtgtgtaaaagtgggaaacacactttgttttcctatctcctataactgtaaacatggtaaataactgtaaaccaaaacaaaacctgattgcttcacttacctataaggctaaaaattctgcgaacacataaagttgaaaaattccattttgcccttaaattgtcagcagcttgaccagacaggatcatacataaccaagagcctaaataaggcaatgaagataaaaacccattctggaaggaataagaagatacaggattaattacggtgagagaaaaaaacaaaacatacacattcatcacagccaatgaccaccacttgaaagcaaaggaaatgcatagcaatatgttgttaattttttaatataattacagtaaataagtctggctgtcagaaggattatagggttcagtccaaggcagtccctaagagtctgtctcagagggaaataagccttgccctagtcctgtctgcttcgggtaatcttgactgtttctctgggatctgggttgtgagagaagacaaaccttcctgttagcctatggattctccctactgaacattttcatcttccattctcactcatttatttaaaaaaaattttttttactataaaataaaatgcagatgcagaaaaccacataaacatagcttaatgaatcattctttttttttttttttttttttttgagatggagtcttactctgtcactcaggctggagtacaggggtgtgatctcgactcactgcaacctctgcctcctgggttcaagtgattctcctgcctcagcctcccgagtagctggggttacaggtgcctgctaccacacctggctaatttttgtatttttattagagacggagtttcaccgtcttggccaggctggtcttgaacttctgaccttgtgatccacccaccttggcctcccaaagtactgggattacaggcatgagccaccgcacccggcctcatgagtctttctaatgaccatctaggtcaagaaatagaactttgccagccttgccagaagacacttcatggtcctagtcctatcagagccctcttcctccccccttaaataagcattaacctcgttttggtgtatagtaatcatgtactcacttttatttatagttacatcacccaaatgtacatccctagacacttcgatttagtcttggccattaaaatttttttgatttgccttttatgtctctttaaatctgtaagttcccttccattcatttttttcttacaatttatctatttcttaaaatttatcggtgcccagtaaaacaataactcaaaagtgcattacatgtttatttactacacacacacacacacacacacacacacacacacgtttatttttaacagaactggagagtcttttttttttttttcttttgagacagagtcttgctctgttgcctaggctggagtgcagtggcgtgatcttggctcattgcaacctccaccttctgggttccagcaattctcctgcctcagcctcctgagtagctacgattgcaggcgtgtgtcaccacgcccggctaatttgtatttttagtagagacggagtttcgccatgttggccaggctaatctcgaactcctgacttcaagtgatctggccgcctcagcctcccaaagtgctgggattacagggatgagccaccgcgcctggcctctgagagtctttcctgatggtttcttttccctcatttttcgcgtccaatcatcaagcattgcctattctacttcccttaaacaaacaaacaaaaaaagcttggctgggcacagtggctcatgcctgtaatcccagcactttgggaggccgcggaggaagaatcacttgaggacggggctcaagaccagcctggtcaacatggcaaaaccctgtatctactaaaaatacaaaaaattagctgggcatcatgatacatgactgtaatcccagttacttgggaggctgaggcagaagaatcgcttgaacctgggaggtggaggttgcagtgaaccaagattgctctggtgcagtcagtccagcatgggtgacagagcaagactctgtctcagaaagaaaaaaaacaaaaaaaagaaaaaaaaacacaattccatttagacttctgcacggtgggatcacatctatcattatttgtggcaaaatcctgtataagaataaatggtttcaaaatattagtaggaaagtaaaaaagaataagctgtagtaaatcagataagtgaattttctgatcttgattttgtttcctggtgggataaggttgataattcctcacagttagtaatattgccacttcaagttgcaatgctaaaaactgccggctaggcacggtggctcatgcctgtaatcccagcactttgggaggccaaggcaggcagatcacctgaggtcagcagtttgagaccagcttggtgaacatggtgaaacctcatctctactaataatacaaaaattaggtgtggcggtggatgcctgtaatcccagctactagggaggccgaggcaggagaatcgcttgaacctgagaggcggaggttgcagtgagccaagattgcgccactgcgctccagcctgggcaacaacctaaatacactaaagtcttcagcatttatacattccacaggcaccttccacagttgttaagttttctcttcaaggataagatcccttgtattcatttatttaaaaaaattgattccaatttttttgcaggcgcattggctcacgtctgtaatcccagccctttgggaggccaaggcaaagggatcacttgaggtcaggagtttgagaccagcctggccaacatggtaaaaccctgtctctacaaaaataaaaaatttagccaggtgtggtggcacacacctgaaatctcaggtacttgggaggctgacagaggagaatcgcttgaacccgggaggtggaggttgcagtgagctgaggtcgtaccactgaactctagcctgggcaacagagcaagactcagtcttaaaataaaataaaatgaaataaaataaaataaaataaaataaaataaaataaaataaaataaaataaaataaaataaaatgagtttctggttgtgacgacctaccgacgagaacacacctcttgcaaaaaatttccttcatccctctccagaagaggagaagaggaaacacaagaagaaatgcctggtgcagagcactaattcctacttcatggatgtgaagtgcccaggacgctataaaatcatcacggtctttactcatgcacaaacagtagttttgtgtgttgggtgctctactgtcctctgccagcctacaggaggaaaagcaaggcttatggaaggatgttccttcaggaggaagcagcactaagagcactctgaatcaagatgagtggaaaaccatctctataaacacattttagataaaagatttaaaaaaatgagagatatgtgactcttgctttcacttgaatacttgcaggccatcgtagggttatttattttgtttttctgtacagacggagtcttgctctgtcacccaggctggagtgcagtggtgtgatcttggctcactgcaacttctgcctcccaggttcaaggaattctcctgcctcagtctcccgaggtgctgggattacaggcacgagctgccatgcctggctaacttcttttgtattttagtagagatgggatttcaccgtgttgctcaggctggtctcgaactcttgagcacaggcaatccgcccgcctcggcttcccaaagtgctaggtgcgtgagccactgcgcccggccactgtagggttattaaccagcctaatttcaatattgttgtgtctcagggaatagggaagctcaaggagaaggaaagagatggggtagtggctggttggcagagccgtcagaagacactcaacatttattaagtttgccatcttatatggggaaggattatggtgccccccaacaattacaacactaacttcaaagatcaagagccctgaagtgagcacatgctgttggaaaaatggtgctaacggatttgctccatgcagggttagcacaaatcttcaattcataaaaaatacaatatttgcagagtataataaagcaaagtgcaataaaaggaggcatgccacgcttctcaaagcaagcttattttgaacaaaggccatctgatggccaggcagggtggttcatgcctgtaatcccaacactttgggaggctgaggcaggaggatcatttgagctcaggagtatgaaaccaacctggacaataatgggaaaccccatctctactatttaaaaaaaacaaaaacaaaaacacctaggccatttcatgaatgtaacacattgattttcaagaaaaaaaatcaattaaaaaataggctatataattatagaattattttcaaactctattcacatttctttttattttacagaatgaaagaaggtcctatattcacatttcttttaattttaattaagataaacctttttgtctatgaaaatgcaagataaaagatccttgttttaaagtacacaacattaattactggccagctattgatattttatttcttccatatatagttcttcctggaaaatctcaaatagaaacatcagtgtagtaatctttaaatatactttataagtaaaataagatattttgttaatatgattttgagaatttgtttttttttttttttttttgagatggagtcttgctctgttgcccaggctggagtgcaatggcatggcctcagctcactgcaacctctgcctcctgggttccagtgattctcctgcttcagcctctcgagtagctaggactacaagtgcctgctaccatgcctggctaatttttatatttttagtagagatggggtttcacatgttggccaggctggccttgaactcctgacctcaagtgatccacccacctcggcctcccaaagtgctggtattacaggtgtgaaccactgggcccggctggatttgctatttttaatcttcctgtggatctcagttttaccccaaatgataattaccaaattaacctttcaatgcacagttgaatgcaattaatcactgtagtagtatattatttatttctttcttttttaaaaatcagccccactttatagttgaaatgtagtagtagattataatcaggctctgttaacagagaacttgggaaaaataagattgctcacaatgaatccatcccattatgttgccaaagcctagtttcaatttaacttctgtcagtgcaatttgtggaaatatttctatatagtgatcttgtttttcagaagtagacagaggagttcttcacagcttagctgcctgaagttttaaggtttggtccacatagccaggccaatgtttatggtatactttggaatgtgagtgactgaggattcactttaatagtttttaaagcaggtaagtccatgtagccagtgcagttgtgcagtcagccttgttagcattttttttttttttcctgggacagagtcttgttctgctgcccaggctggagtgcaggggcatgacctcagctcactgcaaccttcgcctcctgggttcaagagattctcgtgcctcagcctccctagtagctgggattacaggtgtaggccaccatgcccggttaatttttttgtgtgtttttagtagagacggttttgctgtattatccaatctgtattatcgaactcctgggctcaagcagtccttctgcctcagcctcccaaagtgctgggattaattattattattattattttttgagatggagtttcactcttgttgcccaggctggagtgcaatggcttgatcctgggtcaccacaatttccgcttcccgggttcaagcaattctcctgcctcaacctctcgagtagctgggattacaggcatgcactaccacgcctggttaattttgtatttttagtagagatgaggtttctccatatttgtcaggctggtctcaaactcctgacctcaggtgatccgcctgccttggcctcccaaagtgctgggattataggcgtgagcgaccgcgcctggccttttttgtatttttaacagagacagggtttcaccatgttgcccggtctggtctcaaatgcctggcctcaagtaatccacctgcctcgacctcccaaagtggtaggattgcaggcgtgagccactacacccggcctgatgtcgggcatccttacatgtgcttattggccatctgtgtatctttggagaaatgtgtattcgtattcaagtcctttgcccattttaaaaactgagttgtctttttattattgaattgtaagaattcttaatatgtctggatactagacccttattagatgtttgatttataaatgctttctcccattcagtgggttgtttttcattttcttaatagtcctttgatgtataagaatctctaaaatttaggacagcagagtaaaatggaagatacagaataactgaattttatacagatgagaacaaattctgtgtatggtcttatactatatatataagaagcagatgattattttttcttacctcttgaacattgaaccttaggatctccttcatataagtaggcaataatgtcaataaagtataaaaagtccagttgtaagaaaagtgtgcaactacgatagcccaaagtggcagggattttaaaatgggtacccacggcactgacttctgtgaagaaagctgaagaaaacaggaataattaggataaactacggctatgttaatgcttagatctgtaccgtatcagctaaaactctatccagaattcatacagaatatcaccttaattagtaaactccaaatttttaaatcaactcctttgaaatattaaatagcaaaatacatgataaatatttagttgtttgattttttaaaaaatatattaactagaaagtccatgattcagattagaggaaaaagtaaaaatgtattcgtagagctataatgtcaaccctaaacattctttatgaatgtcagaagtcacctgcagcattgatttatctatttctttctttcttttttttttttttcttttttgagacaagtttcactcttgttgcccaggctggagtgcaatggcacaatctcggctcactgcaacctctgcctcctgagttcaagtgattctcctgcctcagcctcccaagtagctgggattataggcatactccaccaggcctggctaatttttgcatttttagtagaaacggggtttcaccatgttggttaggctggtcttgaactcctgactgcaagtgatccgacccaaagtgctgggattacaggcgtgagccaccgtgcccggcctgaattctctatttctaaaatatagtttcacggtcagattcagaggttgacataaggataaaggaaagagattggaaggtcctgttagaattcatgtttaattatccaatctttattcaattgaaatgatttataaaaattaggcaatacaaggtttctgtatgcagccatatgcagtagtggtctttaaagcagggtaaaagcaccataggggtatgcaagatgatctgttggggtgaggaaagacatatttctatttatttccatttttactcatttttattataaaaataaaaaaacacactctattaatatttaataaatatgttggccctggagtatgtcaggtgattacaaatcgtatgagtcccccaattcagagaggttaataatggcatcctcacttgtttgtttgccctcagagtattatagcatattgcagtttaagtactattttattttattttaagagagtcttgctctgtcacccaggctggagtgcagtggcatgatctcggctcactgcaacttctgcctccccacttcaagtcggattctcctgcctcagcctcacgagtagctgggactatgggcatgcaccaccatgcctgactaatttttgtattttcagtagagacaaggtttcactatgttgcccaggctggtctcgaactcctgacctcaggtgatccacctgccttggcctcccaaagtgttgggattacaggcgtgagccactgcacctggcctatgtatttttttttgagatggagtcttgctctattgcccaggctggagtgcagtggtgcaatctcagctcactgcaacctctgcctcccgggttcaagcaatctccggcctcagccccccaagtagctgggattacaggtgtgcaccaccacatctggctaatttttgtattttagtaaaggcggggtttcatcatgttggccaggctggtttcgaactcctgacctgaagtgatctgcctgcctcagcctcccaaagttctgggattacaggtgtgagccactgcccccagcgtaagtgatttattttaagtgtcttttatttttatttatttatttatttatttatttatttatttatttatttatttatttttgagatggagtctcgctctgttgctcaggctggattgcagtggcgcgatttcggctcactgcaacttctctctcccaggttcaagtgattctcctgcctcagcctcctgagtagctggaatcacaggcacgtgccaccatgtctggcaaatgttttgtatttttagtagagacagagtttcaccgtgttagccaggatggtctcgatctcctgacctcgtgatctgtccgcctcagcctcccaaagtgctgggattacaggcgtgagccaccgtacccggctgagctgccacttttcttgatgagtcctttgtcaactacttcgccaagcaaaataatggcagatcattaactataacatagtcaaacacattgctccctttaaatattattatatcaacaaattatggctgggcatggtggctcacacctgtaattccagcactttgggaggccgaggcgggcagataactggaggccaacagttcgagaccaacctgggcaacatggtgaaaccctgtctctactaaaaatacaaaaattagccgggtgtggtggtgcgcagcagtaattccagctggttaagagtctgaggcatgagaattgcttgaacccgggaggtggaggttgcagagagctgagatcacgctactgcactcccgcctgggcgacagagcgagactctgtctcaaaaaataaaaacaacaaattatttgtaatttttaagttatagcaaagaagtttttttctattaagatgtaaattttatgtatattctgtttatttcatctatcaatcctttaaaaagtctatttctgtatatattttatgatatacataagtatcatagtacatatagataacttaagaataaatatacggccaggcgtggtggctcatgccagtaatcccagcactttgggaggccgaggcaggcggatcatgaggtcaagagatcaagaccatcctggccaacatggtgaaaccccgtctctactaaaaatacaaaaattagctggatgtggtggcgcgacctgtagtcccagctacttgggaggctgaggcaggagaatcgcttgaactcagggagcggaggttgcagtgagctaagatcacatcactgcactccagcttggcgacagagcaacactctgtctcaaaagaaaacaatatatatatatacattcagattgtgagcctcccacctgtttattgattcttgcatgatcaagaaagcttggataccactgatatttagggcatcagatttttatattttctatacgctaagactgttgtttttctcaaaagcaagagcaatctatgtttctgccttcagagttcacagttgctgttattttaaaaagaggaagaaccagtattgcccaaccttcttctggcctttttcatatggactttttacttgacatctttgtagatatgctcttgtgttttttaattacaaattttaaaaaattattatttatttatgagatggagtcttgctctgttgtccaggatggagtgcagtggcgcgatcttggctcactgcaacctctgcctctgaggttcaaacgattctcctgcctcagcctcccgagtagctgggattataggcacccgccaccacccctggctgatttttgtatttttagtagagatggggtttcaccatattggccaggctggtggtgaactcttgacctcaggtgatccgctagcctcggtctcccaaagtgctgggattacaagcgtgagccagtgagccattgcgcttggttgtattttttaatatgatcaaagatgtacagatatagggaaagagaaggagagagaacattgattcttttacagcagtggttttcaactccagctatactttacaattataggggcctgtgttctactctctgcctattgaataaacaaaacaaaaacaagtaaggcaaaaaaactctgagtgtagggccaaggaatctaagttttaaaaggcttcactggtgattctatagagcagtgggttcccaaactttgctgcatataagaatcacccaggggagccttaaaaacactgagaccaaggtcacaccacagaccaattgaataggttgtgggtgggtgggaggtaagtatccctagtttttgaagatccctgggtgatttcaatgtgcagcaagtttgggacccactgctgtagagatcagattttaaaaagtctgcccttatccttcttgattgaaaagctcagggcagagaggattttagagtttgaaggaatttggaacatagctctttttatatggctttgaaatccacaaaggaagtgaaatcattcttttatgctgaaaggtacaagtgtaaatgtatttgatctctgaaaactgaatgtattctgaagaatgtaccctacctcttggaaacataacctgaaataagaaatatttaattttagtcacactggtatgttttcacaacctataaatatcaattgagtttttgataatctgatgtttttgaacaatcacccaaccaagatgagctgtatgtctaacacataagcccttcacatggcaggttctcaatagctgcttatcaaacgaatacaaggctcacagggttagaggcttagaaagaagaatgtgaaatgtatgtattccagcttagtgttcatttgtaatctaggtacaacacaacagttttctgttctcccaatatgaattgtaagatcaacttatagtatttccacattacaagttatatttcagggggaaagtcttcatttataaaaactttcaagttaaagatgaattttcaaatgttactaggagaaactatccgcgtatctagcagacatttataaaaaaatccttcaagagtttaaggtagtgctgtccagtagaactttccatgatgatggaaatgttttatatgcacattgtccacagggtaaccagtagttacatgtggttattaaatcttgtccttctaacaggttgatgaaagaaaatgaagtgaaacaaaacccttgtcatatgtgtgacatatgtgtgactgaataactaaatttttttatttttagatggagtcttgctctgttgcccaggctggagttcagtggagcgatctcggctcactacaacctccgcctcctgggttcaagtgattctcccacctcagcctcccgagtagctgggattataagcactcactgtcatgcctggctaatttttgtattttggtagagatgggggtttcactaagttgaccaggctggtcttgaactcgtgacctcaggtgatccactcactttggcctcccaaagtgctgggattacaggcgtgagccaccacgcctggccagaactaatttttttttttttcttgagacggagtctcgctctgtcgccaggctggagtgcagtgtcgtgatctcggctcactgcaacctccacctcccaggttcaagtgattctcttgcctcagcttcctgagtagctgggactacaggcgcgtgccactatgcctggctaatttttgtatttttagtagagatgggatttcaccatgttggccaggatggtctctatctgttgacctcgtgatctgcgtgcctcagcctcccaaagtactgggattacaggtgtgagcgaccgtgcctggccaaaactaaatttttaattaaattagttaaattaaaaatataacagccacgtggagctagtggctaccatactggacaacacaaggttgggcttaagaaggtacaaaacagctttttttgatgttctggatctagaaattattctcttgctattgtttctaacacactactatcttgccaatcaagcaatgtaaacacatactctcgatggcttcatcatatctaattgttggcaaaaaattaaaaattatgaaagcatttttttttttttttgagaaggaatctcactctgttgcccaggctggagtgcagtggcacgatctcaactcactgcagcctctgcctcccaggttcgagcaattctcctgactcagcctcctgagaagctgggattataggcacctgctaccacacccggctaatttttgtatttttagtagagacagggtttcaccacgttggccaggcttgtctagaactcctaacctcaggcgatccacctgcctcaaaagtgctgggattacaggcgtgagccactgtgcctgccacttttttttttttttttgagacagggtttcgctctgtcgcacaggctggagtgcagaggcgcgatcacggctactgcaacctcaacctcctgggctctagtgatcctctcacctcagcctcctgagtagctgagactacaggcatgtgccaccacaccgggtaatttttaaattttttgtagaaatggggtctccctatgttgcccaggcaggtctctaacccctgggttcaagtgatccttccacctaggcctcccaaagtgatcggattacaggcataagtcactgcacctggtcctgaaagttcctattagagggctacattattctaaaataccactgctgataaaagaaaatacatatgcgtggctgggcgtggtggctcacacctgtaatcccagcactttggaggccaaggcaggcggatcacttgaggccaggagttcgagaccaacttggccaacacagtgaaaccctggctctactaaaaatataaacaattagccgggaatggtgatgcgtgcatgtaatcccagctactcgggaggctgaggcatgagaatcgcttgaacccgggaagcagaggttgcaatgagctgagatagtgccactgctctccagcttggggaacagagggagactctgtcctccccacccccaccccccaaaaaggaaaatacatacaggcaaaaaaatttaaaattgctcagatcatttgctcagccaacattttgaaagcaaatatactttggagatttaaatgataatggaatttgtgaaggaaaaatcaatgagatcctgaatcttgtattcagaatgtatcatcgaatttctaataatagctcaatcaactttttttccatataagttgaaacagaaaaggacaaactataaaaattatttgtcatgaaatgtgtgaaatatagagggtaagatcactcgacaaatacttgaatatattctaatatgccatttaaaaaaaatttttcttgtcaaatgcaagtaacagcaaattgatttagcaaagttacatgtaaaaaatgctcttaatttctgtcttaatttgacaactaaatattcaaaccaaggtccccatttgatttgcttcgcaatgctgcaaaattgtatactcttcctaaaaggcataaaggagaagtaaaacagttacaaaacatgctatcttcaggctgggcatggtggctcatgcctgtaatcccagcactttggaggctgaggcaggcagatcacttgagttcacaagttcaagaccagcctgggcaacatggcaaaaccctgtctctacaaaaaatacaaaaattagccaggctttgtggtacacacctgtcgtcccaactacttggtaggctgaggtgggaggatggcttgaacccgggaggcagagggaggctgcagtgagccaagatcatgctactgcactccagcctaggcaacagaaccagactttgtgtcaaaaaacaaaacaacacacaaacaaaaacaaaaaacaaacccagaaccaaccaaacaagaaaaccccatgatatccttggaattaagaaaagaagaagaagccgggtgtggtggctcacgcttgtaatcccagcactttgggaggccgaagctggtagatcacctgaggttgggagtttgagaccagcctgaccaacatgcagaaaccctgtctccactaaaaatacaaaaaaattagctgggcgtggtggtgcatgcctgtaatcccagctacttgggaggctgaggcaggagaatcactagaacccaggaggcggaggttgcagtgagccaggatcgcaccattgcactccagcctgggcaacaagagaacaagagcgaaactccgtctcaaaaaaacaagaagaaagaaaagaagaagaacaaaaatagcagatatataggaaagaacacttcaatgggtgaagtggtaatgtctttccataattcattaaaaggagatcttcaacatagaggagtagctgatgatcttaaagcactcgctagtcatgagatggtccttctgaatttaactgcagcgtgcaatgaagatttttatttctctattttttttttttttgagatagagtcttgctctgtcgcccaggctggagtgcagtggtatgatcttggctcactgtaacctccgcctcccaggttcaagtgattcttctgcctcagcctctcgagtagctgggactacaggcacacgctacgacgcctggctaatttttgtatttttactagagatggagctttgccatattggccaggctggtctcaaactcctgacctcatgatccgcctgccttggcctcccaaagtgctgggattacaggtgtgagccaccgtacccagcctatttctcttcttgtagaaatttctgaatcagaattagaactatatatgctatcataattgtaaaatccacttattgtaagaatgaaatcacatttctacctataagtactgactttttcttggttggataactgagaaaacatttgaactgcaactcttgcttgtccagctcagatctccttcgacatgactgccagcataagctatctacaatgcaaatctgattctgtcacttcgagcttacaaatacttcatggcatcccagtgcctaaaggataaaggctaagctccttagggaggcacagaggaccctctgtgacctgacttccagctgttcctcctcctgctgttttttgcctttaccttatgcacgagagcaacacccaacagccacatttcctagaaggtgtcactctctctctagaagatatcactctttctctcaggaaagtgagaaagaaaaaaagcagtcaggccgggtgtggtggctcccacctgtaatacaagcacttcgggagatgaaggcgggcggatcacctgaggttgggagttcgagaccagcctgaccaacgtggagaaaccccgtttctactaaaaatacaaaattagctgggtgtggtggtgcacacctgttatcccggctactcgggaggctgaggcaggagagtcacttgaaactgggaggcggatgttgcagtgagctgagatcgtgccattgtacttcagcctgggcaaaaagagcaaaactctgtctcaaaagaaaaaaaaaaaaaaagaaaaaaagcagtcctgggctgcggtaagctaaactgtcctggttctaacatctaggcctggggttgtcctgttgaaccgaaaccaggccactctatgagcatgctggagcaagacaaaaataagaccactttacagtgagctgagatcaccccactgcatgacagtccgggagacagagcgagaccctgtctctaaaaagaagaagaaaaagaaaaaaaaccactccacagtcatgtctgagcacagacaaaaacacaaatgccataaactacaaaaaatgcgaaacatcttcctctcccagctaatatgagtgactgctgtgcccttactaatcacagctttaccccaccttctagataaaaattcatcatagaattatcaaatccagagcaaaatattgattctttaaacccttcccaaagtcacctactgcaagtctaaactgcaacaagttcctctcaactctgcactaagatgccccatggttcttcatggtgtgctttcttcctcactgcaacgaaccaagaaacccaacttgttcaactacaagtgtgttcctttggccaaaaggcactgacacaaggaagcttttcctgtctgccccaggctggctgaggactgccaccttctctgttccaaagatgtcctgtaccttacagcactgcattatgcaggctatattgtattgaaattctgtccatccatgtctgtctccctctggagaccttgggccccacaggaaccatgttttatttttttcctcttattcatttttaagtcctcagctgacaaagaacctaggtcatagtaaagtttcaaaaaaaaatgtttaaagaatgaatgagtagatgctgcacatttcttgggtccaagatttaaagatgcagcttcacgtaacacatcattttacaacactgtcaactataacgtcatgtgctttaagaatgcagtctggttgtacaaggtgactcatgcctgtaatcccagcattttgggagtcttaggcaggaagactccttaagcccagcagtttgagaccagcttgatcatcatagcgagactccgtctctacaaaaaataattagctaggcatggtggtgtgcacctgtagtcccagctactcgagaggctgaggtgggaagactgcttgaacctgtagggttgaggctgcactgagctgtgatggtgccactgtactccagcctgggcactgagctagactcaaaaaaaaaaaaaaaaaaaaaaaggaatgcaatctgggcttctcctcctaactctcttgcctctgaatattcctttttccgaagtgtgtcgagaaacaacctaagtttggagagattaagacacatatcgatgtagagaaagcttttttttttttttttttttttttttaagacagggtcttgctctgttgcccaagctggagtgcagtggcacaaacacagcttactataccgttgacttcccaggctcactcaatcctcctgctgcagccagccgagtagctgggactacaagtgcataacctcatgcttggctaatttttaaattttttgtagagatgaggtctcgtcatgttgcccaggctggtctcaattcctgggcccaagcaatccttccatcttggcctccctaagtgttgggattacagatgcgagccaccacccctggccaagggaaagctttttaaaaaatttaaacaaactcaaaagttttatcagttctggaagatcatgataaaaatgaaatattggagaaagcaagctgttacccatcaatgttgagaaaatgacaaaacatatcaagttttacatggcaacatctgtttataatgtgttaaattttttttacctgttccttaaggggaaaaaagtgggtaactcaattaacatcaggtaggactctaaactttcaaagtaacttaacttatttatttgagacatggtcttgctctgttgcccaggttggagtgcaatggctgatcatagttcactgcaaccttgacctgctggacttaagcagtccccttgcctcagcctcctgaggagctggaactgcacttgtgtgccaccatacccagctaaaactttcttttttacttgtattaattttttttttttttttttttgctgggaagactcagacccaagtaaccttggatatgagctctccacctggttaaaactttattacagtgctgatttcttctgtttctaagtttttgccaatctttggcaaagatcaagacaggtcataattcttaaagttcagctgcttgtagagacatttatagcaaaataaaaaacttaaaaagaaatgttaaagagtacatttttccttctttttagagatggggtctcgctatgttgtccaggctggtcttgaactccagggctcaagaaaactgcctgccttagcctcccaaagtgctgggattacaggcgtaaatcaccatgcccagccaagactaagtttttaattttactgcctggttatattgtatataaatatttaaaatatcaatcttgggctaggcacagtggttcatgcctgtaatcccagcactttgggaggccaaggtgggaggatcgcttgaggccaggagttcgagaccagcctggccaataaggtgaaatcccgtctctactaaaaatacaaaaaattagctgggagtggtggcatgcacctgtaatcccagcaactcaggaggctgaggcaggagaattgcttgaaccagggagatagaggttgcagtgagctgagattgtgccactacactccagcctgggtgagagagcgaaactccgtctaaaaaaaaaaataaataaaataaaataaaatatcaatcatgacaatttaataggaaaagtcttaaatattttatgttcttaaactaataaagtgactttgaagccaacaagaatgctgaaaacaaactgtgtatattttaatctttcctaatgtttttatgttcttcttttattctactcaaaaggcaaacattttgtttccatggtttgagaatttagtatattgaattattatagatttttatttgtgatttgcctttgtgctcgattaagtgattgaaatctggttttaataagatataaacttttttctaaagacctactctagaagagcaaacagatgtatatcatattataatattatatcataataaatgtgctgttctctttctttaatgacactcatttaaaatatagatacaggtccaatatcccttgtctgaaatgcttggaaccagaagtgttttggattctggattttagaatatttgtatcacgtaccttcccaattaagcatcctaaatcttgtttttcttttcgagatggagtcttgctctgtcacccaggctggagtgcagtggcacgatctcagctcactgcaacctctgcctcctgggttcaaggaattctcctgtctcagcctcccgagtagctgggactacaggtgtgtgccaccatgcccagctaatttttgtatttttagcagagatggggttttgtcatgttggccgggctgatctcgaactcctgacctcaggcgatccgcctgcctcagcctcccaaagtgctgggattacaggagtgagccatcaggctggccaagcatcctaaatcttaaaatccaaaaatctgaactctgaaatgctccaatgagcatttcctttgagcatcatgtgggttctcaaaaacttttggatttcagagtattttggatttagaattttcagatttgggatgtacaactgtataaacacactagttggttttctaacaactaatggtcagaatgagaatcctttcatgaataacacattttattttctactaatcaagtggaaaaaacaaacttaagactcatttgataatcactacactaaaaggttttaaaatgacttaaaaatattttttatagtttataaaactatactttctataaaaaatgaaagaactgaaattcttcagacaatactttgttcatatttatgtatttaaaatttttttttaaatattttaaatgttttgtagagaaagggtctcactatgttgactaggctagtctcctgacctcaaatgatcctcccacctagacctccccaaaggactgggattacaagtgtgagccactgcacccagccagacaatactttggatgttcatttcatttgcctattctactttgtctagagcatgcacaataggaatatatatttttaaaaactgatatcttaattctgaagaaaaaaagtttctgacattatttttaaaatgtgtcaaagtccatacctgatttcttaatgatgaaagaatgtattccttttcataatgggaaattctcttgtgtttttgtggtgtgtcactaactaaccagatccacaaaagaaaccaaaatattccaatagtaccttaaaatagaaaaataatagttagataaaattagaatgtaccaaataacaaacaaaacaaaacaaaaacacaaaattagaaagcaccaacaacaatttttacatgtcttgaaaaaattatgtaactataaattcaatgtaaaactgacttcagtttggattcaatttcaagtttctctcaattctttaatgggataattgctataactgtattattgcttatacattttgaagaaaacaacttttttttttttttttgagatagagtcttgctctgtctcacaggctggagtgcagtgacgtgatctcggctcactgcaacctccgcctgctgggttcaagcaactctactgtctcagcctcctgagtagctgggactacaggcacgtgccaccacgcctggctaatttttgtattttgagtagagatggggttccaccatgttggccaggctggtcttgaactcctgacctcgtgatccacccgcctcggcctcccaaagtgctgggattacaggtgtgagccactgcacccagccagaagaaaacaacttttaaccacatgactttgcctatcagggtctaccagacaaatctttttgaagatacatttccacaatctacatatttccaaaggtgtctgtttttgttagttgagttttaaattttgattgcagatatatttcttgcatgacatgtctatgtgaaaatctaatttattaaaaatgtgtatcatgctgccaaggaaattgagcaataaaatgccttgggactaagtaaaaagaaaaaaaaaaaaaaaacattaaaactaccaagtgagaacatcctactttgcttgagaagaaattcaaaatacctaagatagtgattttttgatagcaaatgtactatttaagtacaggatcaacagtcatttctactgagaaatattccaaaactaacatcagctcgtaactcaaataggtcaagtaaatcataccaacttgaaaaacaggttatcaggaagtgtttcagaactgtggttcagtgatttggaagatatatttttaaaacattattaggctactattattacattttgaatttgttacattataatttagttaaaattttaaacttaccaaaaaagtagaagacataagtccaattcatatagtagcaaattattccagaaagaggaagagaaattactgtcccaagctgtgctcctagaacaacacataagactattttataaactttggagagagaaacaaggataggacagacaagtctactgcttacagaggatgggtaacaggctgggcacagtggctcattcctgtaatccctgcactttgggaggctgatgtgggtggatcacctgagcctaggagtttgagaccagcctgggcaatatggcaaactcctatctgtactaaaaatacaaaaattatctgggtatggtggtgatgcacgcctgtagtaccagctacttagctacttgggaggttgaggtgggacgatcgcttcagctgttgaggctgcagtgaggggcgattgtgccactgccttccagcctggagtgagaccctggctcaaaaaaaaaaaaaaggctaaaatgtggtcccatagaaacaagattagaaaaaagatatagaggtagtataacaggacaagcaaaggaatggaagtagtaaagcagagagtaggcttgggaacttcatttgggtaaaggaaaggaaaagcagataaagctggaaaaataggttggacagttgaacagttactgagtacctactccatgctaggcactatctgccagagatataaggctagctgcaacaaagtagtgaagactgtaaagaatcttgcccctagttcaaggagtttgggatttattcaataggtaaaagggaaccttagatagtacctgttcttgaacctatcatcagatttctcatgtcaatctcaacatagctgcaagaataatcttcttaaaatgtaattgaatcatgcctcttaaaaaacaatctacattttttcctgtagcctgtaagacctgatataacccggctcttatctctttctctaacctcatcttatgccatcatcctccttactcactgagttctagccatccaaggtagttttccacttcttttaacccttatgttatttcttgcctgagtgccctcgtacatgctgttctgattggctgaaatgctcttctccctgcatgaatggtttgttcttatccttcagattttagcttaaaagtaccacagagaggccttttctcaactactgtatttaaaaagcagtccggtggaaaaattttaatttagtcaatgaaagaaaggctagaatttcttatgcaatctgataaaattataattcacatatataaaactcatgttatctcacctgtagatcaaaatgatggcaaataaagatgcaatagaaaaaagatgcatgaagagaggggttgagaatcatgatacattcattagttaatcaaaacagaaatcacaatttaaggacaaaaacactcaattttctagctactggcctttttttttcttttttttaaatagcatctctaaacaaacaaaaataaaatttaaaacccccaaaaaagtaaacagaaaaagaaaaaaaatagcatctctataccaatatctgaaaacacaacatactttgaaatagatgatggcagatggggaaaatgacattagtcaattaagctgcattactataagttgttgagccaaagagaaaaattggtaataaagttatactaccgaaacttaatgttctccccaaaggggcatccaatccaacattgcatcgttctggtatgcaggccctttttcccaaaggttgatatatacataacatattacagcaaaatttggtaattgttatctcacctgcatatgaaatgctaagaagtttgcttctttcaagagggggagcccaagaagaccacatggcatgcatggctggaaatgtaacaccctgagagaagggaacatgatatttctgatgaaatgtaaggtagttttgttaatgctttaaagtaagttaagtattttgctacaaaagcattttctggataagaatcaaacgaatcaggttccatgaaatgagaaatttttacagtgttaagtgaaaatatcttataatgaagtactttcagaatttgaggctgggtgtggtggctcatgcctgtaatcccagcactttgggaggccaaggcaggaggattgcttgagcccaggagttcgagatcagcctgggtaacgtagtgagacaccatctcttaaaaaaaaaaagtaaaactccccaaagattcatggattttggaactggttttaagacaacaagataagggttacaataaatctaaaataattgtactgagtgaggacataaagggatcttgctcaaggttaattttactcattcactttattaatcacctgaatgaaagggaatattactaacttataactttaaaaaatactgagctaatattttgggatactgaaaaaaaattcaagctgacaatcaaccagaaaaacagtcctattaaaaaaaggatgaattcaattagcatgtttacagcctttcttcttttttttcctgtgataacaagcctagtagatgccaattactgacacggagagctaacaggatgtggaaacagggagtttcatagagactgggtaaatgaggagataccacaggacagtgagagagaacggctctccttggacactctctgtgtcacttcagaaagattagttaacctccctgaacttcaaggcggttgcataattgttgtaaagataaatggtaactagtgctattattagtggagagaagaataaatgttttaatactttgtactttccgctgactctttcaaaaacaaaaacaaaaggaattaaaaaaaagtaataccaatggaaggcaaagatgatttaggtacattgcaaatcaataagaatctatatgatggagcatccacaggatgagtcattatagaagaaaacttgagatgtttggaaatgcccacagagattatgttgtagaaaactttattataaaacctagggacaatgtaggtatatttatggtgaatcagatggtaggaatgcaagatagtaatctaagtgtcctttatgaatgaggaaatgcacctgtgatacatattgaagggatgaagaaggacgagagaacctgagtataaatacaacttaaattctatttagttgttggctggacacggtggctcatgcctgtaatcccagcactttgggaggcggaggcaggtggatcacttgatgccagaagttcgagaccagcctggccaacatggtgaaaccccgcctctactaaatatacaaaaattagccaggcatggtggcgcatgcctgtaatcccacctacttgggaggctgaggaaggagaattgcttgaactcaggaagcggaggttgcagtgagccgagatcatgccactgcactccagcctgggcaacagagtgagactccgtctcaaagactagaaaaaaataaataaatgaataaataaaatgtcacctgagataacagtggtaatatgatcaatatgccgtaatgttaaattagtggcataaactggaagtaaaatatgggaatacattcagcaaggagattgaatactaggatcagagaaaatatgctagatttaagtatattttactttgtcaagaagaacaggaacctggtaatagaggagtaattttaattttgtgatcaggaagggtttacttaatggacctctactgataagaacaaaataaaaacattcagatgaatgaaaaatcttttaatagtacctggcaatttccaaagtattctagcaatccttatcacatatgaattttatatctaatctgtgactgaaaacagggaaggtattttagtcccagtttaaaaaatgatgggactgagatctagagattagagcttacctaaggtttcactgttagatacaatagagctattattcaaactctggtccagtgttcattccaacagcatgatacactgctacttaaaataatcttcatcctctacaccaagcccagtggccattatcttgcttgaattaaagaaatgcaagagagcaaaatacaccattccctggatttcagaggtagaagttcgaagttataaaggaaaagtgaaaattattaagtatgggggtacacatgatgaaatacaaaagaaaagtgggaaggaaaagaaagacaagaatcaaaattttaaaaaatgataaaactattaagaggagggaaataaaagaggcaaaaatcaataatacttctaaaaagagcagaatcatagaactaaattgagatagttatataaaatcataaaatatttgtctctaagttacaagaccagaaaaaataaaagaataagcgataaaaaagaaattaaatgcaactcaacagtctattgtgtaaaatgtgcttcagacttgggcatcaatgatagagcagagtttaacggtggcaagagcacaagaggtaaggatggtcaatcttaaccatttttttttcttttgagatggagacttgctgtcgtccaggctggagtgcagtggcgcgatcttggctcactgcaacctctgcctcccgggttcaagcagttctcccacttcatcctcccgagtagctgcaattacaggtgtgcaccaccatgcccggctaatttttgtatttttagtagagatggggtttcacctgttggccaggctggtctcaaactcctaacctcaagtgatccacctaccttggcctcccaaaatgctgggattacaggcatgagccaccacgcccggactatcttaaccatttattaatggtttattttcttctctcctaaagtatgagctatgaagtctcttttggaaaaaagttttctctggtttttgagtaaaggttccaatttcggggtgctcctactagagacctcatttaccacaaacaaaatctattcaggtaattttctagttagtcctttctctaaaaaataaacccctgttatcatccaacgttattttttggttcatattcataccaaagaatgacatctttaagaagaagagaaggagacacacggtaagaagtaaaacaagagagaaaagaaaattacctctcctagtccttctagtgctctgagtacaatgagtggtccaactcctaaatctgcagcaatgggagtgaacagggtgaggacagcagtgccaaggatcccaaatcctagcagcattttcccccctattttgctggcaacatatcctccaggaatctgtgtgatgatgtagccataaaaaaaggaaccgagaatccatccttgagtttctgcatcccattggtacttcttaccctacaaaaatcagaaaagaataaaacaatcctttaagaccttcacagagcagctcttttctcttactggcatgtaagtacatataaatgagattttgaaccactattttggactgaagaacatgcaaactttctagtaggtgggtgagtcataacaatatagatatacagtatttagaagtgaatgaaaaagaactgacagtcgtaaacttcaagaaggcttgcaattttataaaactagactgcaggatgagctgccagaagctttataataactatgaccaagaaggctcacaaaagaatcacaaaaaaggcttgggtatctctgagcctactatggctcgggaggctgccgcccccccggccctgcctccccctcccaaaaaaagagtcacaggcttaatccagaaagctattaagcagaaaactgtagtggctgagctaggctttgggaaccaggcttggttttaatcctagctctattacttaccgaatgtgtgatctgggaagaggaaatgaaataggcacataaaataaggcttgatgtacagttagtgttcacttagtgctggctattaacatgcataaatgtagatattaataatatctccccatttcagacgaagcacttaaacaagcacatggaacaattccaaagagcaagaatttaaatcaagccacaaacttcatgtgaatagaacctgtgttttcattagtaacagcacacagcaaggtactaatgaagatttagtgactgatctgagtatctgacatttttaatgcagtgtagctgtataacaaagccaacatgtcaagaaccattccgggatttctttctactgctgatataaggcagatgaagataagtagcagggtcaacaaaagcactttgcaaagaaaaagacacaaagcaaactcttacttttccttatttagggtaccaatttgcagtttatctgtggaattctaggatttcatgtacattccagcagtattgtccctgaaggtcacaggttggagtggagaaagtgagtgatgtgtacccaaatgttactcagcaacattattaaagtcaaatataaagattttcggagagatttattttgtttagagagaaaccctctttcctgcttgaatgctctgcttgtgaatgatagaggagattcatctaagtatgaactagtatcttcgtgagcactgaaaatgggtgaaaatttatttatttatttatttatttatttttaaattttttttttgagacggaatctcgctgtggcccaggctggagtgcagtggcgcgatctcggctcactgcaggctccaccccttggggttcacaccattcccccgcttcagcctcccgagtagctgggaccacaggcgcccaccacctcgcccgtctaattttttgtattttcagtagagatggggtttcaccatgttagccaggatggtcttgatctcctgacctcgtgatccatgtgcctcggcctcccaaagtgctgggattacaggtgtgagccaccgcgcccggccaaaaatttattattttttatttatttatttttttgagacgaagtcttgctcttgttgcccaggctggagtggaatggcgtgatctcggctcactgcaaactccacctcccaggttcaagcaattctcctgcctcagcctcctgagtagctgggattataggtgtgtgctaccacgcccagctaatttttgtatttttagtaaagacagggtttcaccgtgttggccaggctggtctcgaactactcacctcaggtgatccacctgcctcagcctcctaaagtgctgggattacaggcatgagtcactgcacccagcctgcaaatgtacttctaaaaagaatactagcttttctttctgtactatctcctcgtgtgataagcaacataaaatgaagtatatataacttaattataaacaaatgatgaatacacatttattaataccactataacataaggcaggcaaaatgacttatgtggcttaggttgggcatgtgtacattcagaaaagaatgtcctaagaaactggccagttcttgtttttcatcttgcaactgagattacctaaactctcttgcagctgtaactctataagtgatatagggttataaataatactcctataaaagctatttagaaaatttaaaacagtttaattttctgttatataaaacaggtttttccaaattttctttaagcatggtatgtttatagagggaatggaagaactacttttcaaacagatgaaggtgtattacggcatagcagtagtagctatagttacaagttattgcccaatcagttcctgggaaaacacaaaaagaaagtgattcagagtatacacaaacaaagtatagtttctgtaggatgaaaaaagaccttttaatatttttacttgcaagtattttaggataattaaaattgtttccttaaaaaatagcacctaccgtttgattatgatgaacttttatgggagcagaatgctctggacacgccttggaagttctattatcttctaaagttgtatttgaatctaccatatccactaacgcaacactcagattcacacgtaatgcatacacaatgaagaaaccaaaaaaggccaaaattgctaagttgtaacgagcagagcagcacactggagctgaaataaagattggggaaaatttttatttatttttaaatttttatttttagagacagggttttgccatgttgcttaggctggtcttgaactcctgggctcaagccatccacccacctcagcctcccaaagtgctgtgattataggcattggccaccatacccggctgctttaattaaaaaagttaattacatgatattgtctaaataatgaaaaaggttgctttttaaaagtacaaaaataattatgaaaaaatgttaaagaatattcttagattaagcaaatctaagaaacatttgtcaaagattagctgtttctcatatctgtagttttggtaaaaatttcacacatgagagcctgaactataaaaaagttcattaaaacatggaggtagtagttttatcacctttgctgagaaaaagatctattccagattcaaactgaacccctactccttgtcagctggcaaagatatacggcatgagaaaagcaggtaaggaggtttaatggcattactatttctgaaaaactatctgaaacatggtcaataagtacttgagtacttacaatgacatgatatattactgattatgagttagtagccatctcattgttaaatgtagcatagcaaaaaaaatttactgccaagggtagggcatgaaatttctcttgataaatttcttacctcgaagagtatcctcaaaggctgggtttgaatcagaagccatgattaatacttaaagccatcgtaaactaaatgcatttaagaatctagaagcaaacttgcagaacctatgacagttgcagcatctgtgacagttgctcagtagttatcaagcgtaaagggctcacagtaaaaagggaaatcagtgaatgtaccaccatgattaaaaaaaaaggatgccgggcacagtggctcacgcctgtaatcccagcactttgggaagccgaggcgggcggatcacctgaggtcaggagatcgagaccatcctggctaactcggtgaaaccccgtctctactaaaaatacaaaaaattagccgggcgtggtcgcgggcgcctgtagtcccagctactcgggaggctgaggcaggagaatggcgtgaacccgggaggcggagcttgcagcgagaggagatcgcgccactgcactccagcctgggcgacagagacagagactccgtctcaaaaaaaaaaaaaaaaaaaaaaagaatgcagagtaggttggaggaaccaataaaaggatcatgtgagaggaggagtttgacctatttattactctaactgtgggcttatgcatagtttctcttttttcttcttttattgagttgcagaattggagagggataggattcaggatgctgactaaggataatcaacctcttagtaacaaagagaaattagctaatccagagtctgaacatctttaagtttagtaaactctgagtggctgataaatacctctttaaagatataaacatgtatttcattaagcaatgacatattaaaattaaatgaaaatatgtgtgcttttatttggtaatgacacatcaacatcatataaatgtgtgtatgtttttcccctacttaagaatcctggtgttttcattaacctagcatcaaaggagagaatatattttacagaatacaaaagtcttgatactggctcagatgaactgatttagactgaaacattaatgaatatgcacaactatacttaggtttatattaatatattatgatccaactcacttttctgtatgccctcctatgtttaacaactgctattatttttttttccctgtgtaagattaacttcttttaacaggaaacttttcatttggcattcttaaatcctttcttcaggggtacagctatgaaatttatggtaccactaccatagttagatccagatctgtaagaactgaatttctaaagttctattcacattgtctctattactagaatctaggcgaatttgctttctgctgcaaccaaatgggcagttgtccagttaatgacggtttggatattgtgaggcatgttttgtaaaaaaacacattttcttttttctttctttttttttttagagacagggtcttgctctgttgcccaagctggagtacagtgggtgatcataactttctgtaacctcgaacccctggactcaagtgatcctctcacctcagcctcttgagtagctgggactaaaggcatatggcagcatatctgactaatttttaaatttttacttgtagagtcggggtctcactattttgcccaggctggtcttgaacttttggcctcaagcaatcctcccatctcagcctcccaaagcactggaattatagacgtgagccactgtgcccagcagaacatgttttctttatcattgctctgtgtcaggtgatattacctagaagtctggatgggggactcaaaaatctagctaaatgtgtgcattaaaatgtgttactttgagcaatttggagcaagaaaaacccagatttatgtactatgtctgttttgtcaatgcagcatttaaaaagatcattacctatttcagcaaaggagtgatgagatgtgatttatggtttaaaaagcttatctggttgatggtttaaagagctcatctggaccctgcatggagactatagaaaggagaagtgtgaagggtgtaaggaatgtacagtcagggagatcacttaaaggactactgtagctttccagctaagagatgaaggtggcttaaactacagtgaaagcagcagtgaagaaaaatgggcagatctgagatgtttaaaggcagaattaacaggccttgcccaaatgttagatgtgggagtaagtgaaggggagggatgaagttattagtaattctcttactctaaaaaactctattttatgctactgtaatttgtaatgttattacttcattctatccttatttgcagttatcttattttactgtacattattagttttccctaagtgatgctttattgggactatgatataccttatcatgtgaattacaaggggctagaatgttgagaaatgaaagaaaggtaagtaaaatgatttcaaattactcgtggtattacttggaaatctgacctacaagttatagatcaggcaactttaacttttggatgcatagtcagtaattagaaaataaaaagcggccaggcacggtggctcacgcctgtaatcccagcactttgggaggacgaagcgggtggatcacctgaggtcaggagtttgtagaccagcctggccaacaaggtgaaaccccgtctctactaaaaatacaaaaattagccgggcgtggtggcaggcacttgtaatcccagctactcgggaggttgaggcaggagactcgcttgaacctgggaggtggaggttgcagtgagccgagatcacgccatcgcactccagcctgggggacaagagcgagacttcgtctcaaaaaaaaaagaaaataaaaagccaactcaggtgtcacaaagtatattactatgagattctaagaaatattaaaaataaacaattactagctaataaaatggttgctgattacaaatatattcaatcagaaaatttttatttcaagaaggtatagcagtaaagaaaaacatgcctgggaatgtgaatattctttgaaattgatccaacaaaagcatgcttgcatgaccaagagagagaacatccattgagcatcaagttcaaagcaaaatcatgcttgcataaggaacatggcacccatcaaaaacaaacatcagcttctaaaatgtgttttaaacttaggaatgtgtgtgggtgtaactgaaagtacacaggctaatttagagtgggacctgggaatgaatctgtttctgatttttcactggctgtgtgcttttgtagaaattacttactagttttcattctcaggtttcttagctataatatgtagagaccaccatctacccactgggctgcatggggattaaatgaaatactgcaagacattatagcaggcacttagtaaaaaggatttcttcctcctttttatctggagaaagttatgccaataagacaaagtactatgtacgtatatataaaaaggaacaaaagaggcacattaatctgatggaggggacagtggagacagtcagagaaggcctcttggagaagtctcttcaaggagcaggaagtcaccagtagggacagatggaacaatccaagcaaaagcagcagcatgtacagaggtatggaaatgagacagataaacatagggagagcaggacattctaaatgatctgcagtatctagattatgtattgtagtaactctaagaactaacactattgagtgggatagtgggtattaagtttaataacataaaataatatataattttttttttttttggagatggagtctttctctgtctcccaggctggagtgcagtggcacaatctcagctcactgcaacctccatcttccaggttcaagcaattctcctgcctcagcctcccgagtagctgggactacaggcatgcatcaccacacccagctaatttttgtatttttggtagagacaggatttcaccatgttagccaggctggtctcaaactcctgacctcaggcaatccgcccaccttggcatcccaaagcattgggattacaggcataagccaccatgcctagacaataatagataatatttattacaagccgggcatggtggctcacactcgtaatcccagcactttgggaagctgagatggggaaggattgcttgagcccaggagttcaagaccagcctgggcaacatgatgaaaccccatctctacaaaaaatttcaaaattagctggttgtggtgttgtgcacctgtaatcccagctacctgggaggctgaggtgggaggatggcttgagtctgggaagtttaggctgcagtgagctgtgattgtgccactgcacttcagcctgggcaacagaataagactcttgtctcaaaaaacaaatattactaagcattttctatacgcttggcactagtcgaagtattttgcctgaattagggttattataaggattcactgagttagtaatgtaaaatacttagaagagtgcttggcacagaataactgtgaattattatgggtttttttttctggaaattaggaattgaggttatttcttaggaattgaggttagttctcatttgtgagaaattgggatctgggaaaagtaagaaattgttgaagagagtgggggcatgaggttctcagtgaaacacaggaatgctgagcagatacccatacagaattggtgggaacaatctgccctagtgtgtaacttcataagcactgcatgcctgtgctcaggagtaggcactaagaaagcagatagctggcaccgagatggatgtgatgacaaagaagggggcaagggaatcgagagtattggcaagaaaataaagtgttgggctgggtgctgtggctcacgcctgtaatcctagcactttgggaggctgacgcaggaggatcacttgagcccaggagtttgagaccagcctgagcaactaagtgagaccttttttctacaaaaaaaaaaaaaaaaaagaaagaaaaaaaggccgggcacggtggctcacgcctgtaatcccagcactctgggaggccgaggcaggtggatcacgtggtcaggagatcgagaccatcctggctaacacggtgaaaccccttctgaactaaaaatagaaaaaattagccgggcgtggtggcgggtgcctgtagtcccagctactcggaggctgaggcaggagaatggcatgaacccgggaggcggagcatgcagtgagccgagatagcgcgactgcagtccagcctgggcgaaagagcaagactccgtctcaaaaaaaaaaaaaaaaaaaaaaaagaaaaagaaaaaaattagccaggtgtggtggcacatgcctgcagtcccagttcttcaggaagcttaggtaggagggtcacttgagcctgggaggttgaggctgcagtaagacctgtttgagccactgcattctagcctgggcaacagagtgagatcctgaaaaaaaaaaaaaagaaaataaagtgttggactttgattgtaacccaagaagaaagcaaaatggagagggctgaaagtttaggaaaatatacactagaatataaaagtctataagggcaggagcttttgttctgttttgtttacttctttgtatctccagtgtctagagccgtgtatgggagaattagcatgctgacacaattctactttctacacttgtattctacttatggaatagtcatgacggtaattaagacagacagactcataatcctatcaaatcttcagatctactaattaccaatttacagtaaatcaggagggcagaagatgttaaaggacaacataaggatataaaattgcagggaaaagaaaaggagcggggcaggggaaacagattaaaagagacaaaaaacatttcaatcatttggaaggtatggacattattgagatcctgatttgaacacactataaaaaattaggacataggcccggcccggtggctcaggcctgtaatcccagcactttgggaggccaaggcgggtggatcacctgaggtcagaagttagagaccagccttgccaacatggtgaaactccgtctctactaaaaatacaaaaattagctgggtgtggtggcgtaggcctgtaatcccagctactcgggaggctgaggcaggagaatcacttgaaccggggaggctgaggctgcagtgagccgagatcgcaccactgcactccagcctgggcgacagagcaaaactccgtctcaaaaaaaaaaaaaaaaaaaaaaaatcaggacataattgaggaaatatgaacactgagtattttgtaagtattattattattttattattattattttttgagacgaagtcttgctcttgtcacccaggctggagtgcaggggcgtgatctcggctcactgcaagctccgcctcccaggttcacgccattctcctgcctcagcctcccgaatagctgggactacaggcacccgccaccacacccggctaattttttgtatttttagtagggacggcgtttcaggcgtttcaccttgttagccgggatggtctcggtctgctgacctcaggtgatccgcccgcctcggcctcccaaagtgagtaagcattatttttatttgctgtgataatagtactgtagttatgttaaaaagagtccttatcttttagaggtaaataattgaaatatttacatatgaaatgacatggtatctgggatttgcttcaaaatacacagtatgtatgagcataaggcaagactggccatgaattgataactttaatctgggtgctggttacatgggggctcattatatacttctcttaattgccatatatgctccttctctataaaacttatcatattctaaatagcaaaaacagtatgttactattatttccacttcacttgctctccagtgggtatgtaaagagggaaaataaaaaaggaaatggttgtaacaaacgtagccacctaaagccaggaaggacagggccagtaccataagatccatacactcaacacatgaatcaagtagggattgtttttaaaagggatgctataagctacttttttaaaaatcaactttattgaagtataatttacgtgataaatgtatacatttgtccatctcaatctttattgagatgtataacttttctatccacatctctgctaacatttggtattatcagccttttggattttagctattctagtgggtgtatagtgcctcgttgtaattttaatctgcattttcctgagaataatgtttaacatttgtgctaaattttgattatacatatacatatttttcaattgtaacaatgtaataatctctggcaaatatctttattataacttttatttctgtatttctatattattttatgaggaatattatacaatttgaacactacaagccacagaaaatgatcagtttatggaactaagtccgacttccaggtaaaacgtaactatggtatggtatttacagtttgtgttgactaaaataagctcccggctgccagatggagctataaggttgccacctctactgccaccatctggtaacattaaaaacaaataaaaatatagaaactatacaattctgggttagccaaagtcaaatttccaacacaactctttctcacgcacagatctttgaaactatagaatgcattcaaactgatttgttctttagttttcgttacttttaaataaactatattacaaaagtgtcaaatagcaaaatattttaattttctcaaattcagggaagatgctttatgacgtacctgcttttcgatttgttccaagacctttggcaaattactttagaactccataggtatcttgaggataactgaaccttttcctaacttaaatcatagactgccagacggaaaaaaaatgtcctcgatgtttttagtctcttactgcacaatgtcaagatatcagctgggttatacaatagttgccctctgcatactcacaaatgttaactccagtccttttttgtcttccctccccgcctaagaagctaccaggtcacatgctggcggatacgcagtggcggaaacctagcggtgacagggaaggacagccctctgcctactgatctgcaggtttctcctccagtttgctcttacaccggggtcctccgctcggaccttagcccattcatttgatgattctctcccagttcgttcttccactgggtcccttgctcagcactacccaaaataaccaccagctcagcgccggctgcaccgccgctcccccgcccccgcccccgcccccgcccccgcccggtggggctgcacctgccgaggccccggctcggctccgcgatcacggtcgcggcccccggggttcccgaggggcttctgcgcaccgaggcaggcgggactgagcggcactctgaacgggctcccctcttaatgtcccctcgcgcctgagcagctccggtcccgccggcgcagggtgcgggtacccgggccatgccggcccagagaccgccgcccccggtaccgctgcccactcgaagcccctggacgaccccgccgcttaccggcttcggcccgtggggcgcccggtagaagaggcgtgcggtccgtgctctcctcgccatcgttccgggccaggtctcgaaccggagacctcatgacgcctacgtgagcaggtgtactcgccacctggcagagaagggagcgccggcccgacagcccgaagcccccgggccgagctggctggaccgggcggggcgggggcgatgacaccgccccgcggccac

SEQ ID NO: 242 - DNA, 307019 bp, Homo sapiens
aagaatttcataattatcttgtttaatctctttttttttttcacacttgactttcaggtcaacttttgaatctcattgtacagatgagaaaattgaggctcagaaggaagtgacttgtgcaaggtcatacagcaaaccagatgctaacgcagaataagaggcgccctaggatcctgcctggtgccctgcagtgcccgaccatctgcttagtaaaacctactgcttgctgaagttcctgcacatccaaccagcacacctaacgcaaagtatgacttctttgtggaagttaatgattaaaacctagtctgatctaaagcatcttatccatggttactaattaagccaatttcagtgacagaaagcatttcaaacagaacagtgttctcttaagctaaatctataggcctcaaattatggtggcataaactgtacaattatgatattttgagtacacttaaaatattttataatacaatacattaacctctgtagctttacattttctcttcattgcatgccacatgttgggccctgataaaatggttttataacttttgggggagggctttaactaaaataacttcatgtagtgtttgagcgaactaggtaataaaatctgtttgctgtattcgctgtctccagatagggctgtaattacaccacatgaggaagaaaggtagctgagtttcaatctagatcatttatgtaaactcagccttcttgtcaacggtgttctcaaattgcatgagtgcaaacctcaaaaatcatctcctatgaaccacacagagacagtgtccgattgcaggcctgtgagattgcttatattctttctgtaattggatgtctgtggttcaagaccaaaatttgacattctgaggttaaaagaacactctcaccaatgaattccctagtacaaaaattctgtttctgaaactcgtaaaaattaaagtatgccttaaaccaaagtattacaaatgaatacatttcacttgaaaaaaagctcctttttccttaaagaaaaaaaaaatttggttctttgaaatgtgtttgaataaaaaaactgatcttcaggaaagaaaaacagactattcctaatataaccaatttaacatttgataacattttaatctcctacttcaagtatttggcaacttttcggcaatttctccaaaaagacattataaaaaccataaagcacaaagtatattcatactgcattataaatccagagacatgaggccaggtgcagtggctcaagcctctaatcccagcactttgggaggccgaggcaggcggatcacctgaggtcaggagttcgagactagcctgaccaacatagtgaaaccccatctctactaaaaatacaaaattagccaggcgtggtggcaggtgcctgtaattccagctactcgggaggctgaggcaggagaatcacttgaacccaggaggcggaggttgcagtgagtcaaaactgcaccattgcactccagcctgggcaacaagagcaaaactacatctaaaaaaaaaataataataatccagagacataattacaagccaacaaataaaacatatttttctcaatccattgaactactctccattatgacaaattggtcactagtttttgattagacaatcctccctggttggtattgagagcatttctcttgacacctgcagcttccaacttgctttgtcctctctagcaggaaaaaccacaggccaccgccctggcgccatccctggctcggtccaatcaataaggacttatttcctgtccatttgctgaggtcacaggagcgaatctcattaattatttctgcgactgcagcctcaagtgtgcttctggcgtgacaagtgaaaactgcttgacctttttttcttctaattttgtttgtagcagttccaaaaagaaagcagaactcatttagcaatgtgataaaaggaaggaaaaatgcatatgttttaaaagtcattaacgcatcgtgaaagcgctcccaatcaacctcattccctaggattttcagctaactaacaatagtgtctttttaatttgatgtcatgaaaatctggtcacagcaaacacaatgttttctaaagcagatctggcctccgagggaggaaagctctccagggcctccagtgccttgtttccatggtaacgacacaggtcaatagctgaagtcacacctttgccagctttgattctttctcgcaactgttaagaaacaaatgcatgataaaagtcagttttaaaggtacacagtaagcaccacaattaaattggggaggggagatggaaaacaaagaaagggagaaatagtatagattgagtatttctgctacgttattttctggaaaagaggacatcatttcccagtgatcttgaggcactcattccctaaggctgcttggtgtctgtgctccagagcagcacaataggttccaatcagcttaattacagctcctcctgactcccatcccttaatatcttgaaatgtgccatgctgggggatggcagtaagaaggcggagggcatttacatctctggcattttgaattcagcagcctgatattcttcccttttttttttttttttttaaagagatggagtctcgctctgtcgcccaggatggagtgcagtggtgcgatctcggctcactgcaacctccgcctcctgggtttaagcaattctcctgcctcagcctcccacatagctgggactacaggcatgcgccaccacacccatctaatttttgtattttttagtagagacagcgttttgccatgttggccaggctggtctcgaactcctgacctcaagtgatccacctgcctaggctgcccaaagtgctgggattacaggtgtgagccaccgcacctggccagcagcctgatattcttatgtgaggaaggcttcactaatatcttagttaataactttttttttaacaccatatgttgacacaatagtccatatgaaaattcaagaaagacacatagtattagatctgaatgttactttttttttttttttttgagacggagtctcactctgttgccaggctggagtgcagtggcacaatctctgctcacagcaaccttcgcctctcgggttcaagcgattatcctgcctcagcctcctaagtagctgggactacaggtgtgcaccaccacgcccaggtaacttttgtatttttggtagagaaggggtttcgccatgttggccaggctggtctggatctcttgacctcgtgatccccctgccttagcctcccaaaaagctgggattacaggcatgagccaccttgcccggccttttttttttttttttttttttttttttttgagacaaagtttcgctctgtcatccaggctggagtgcagtggcatgatcttgtctcattgcaacctccgcctcccggattcaagcaattcttctgcctcagccacctgagtagctgggattacaggcgcctgccaccacacctggctaattttggtatttttggtagagatggggttttgccatgttggccaggctggtctccgtctccagacctcaggcaatccgcctgcctcagccttccaaaatgctaggattacaggcgtaagccactgtgcccggcctgaatgcttttttttttttttttttcctgagatggagtctcgctctgtcacccaggctgggatgcagctatctcagctcactgcaagctctgccttccaggttcacaccattctcctgcctcagcctcccgagtagctgggactacaggtacccaccaccatgcccggctaattttttgtatttttagtacagacagggtttcaccgtgttagccaggatggtctccatctcctgaccttgtgatccgcccacctcggcctcccaaagtgctgggattacaggcgtgagccaccatgcctggccagtctggctaattctctaagtcagaaacccagacgtcttcattccccacatccggttaggcacaggggcagtctcagggttgctcattcacagctgaactttctggctcccagagattgggtgtagccaggtgacaagttctggtctatgagttgtgaatgagggatgtcactttgtggctgcagcatttaactgtcctgtgagtccttagagagctttccctcttgcacagctaccagcccacactggagatgctccttggcctggatccctgagtgactgtaatgagcaccacagtgcctcgcccacctgtggcagccgaggttgtgaaattatctgtagccattttgactgataacaatgaatcccagtctttctatctcttcagagctctcaagtttatcctctactcctcattcccattgccactacattagttcaggccatcatcatctctcacctcagttagtttttgcaatcacttcctaaagagtcttcccaccaccaggtctgcacccctggactccatctactatgctgccaaggagatcttaataaaatgcaaagacaatcttgcttaaacccttccaatagccttaagagaaaagtctaagctctttcatgaggcatttaagtcccttgccaagctagctcttgcttggcctcacttttccccccttttcctcctttatttatttatgtattttttgagacagagtcttgctctgtcacccaggctggagcgcagtggtgtgatcttggctcactgcaacttccagttccccggctcaagtgatctttccacctcagccacccgggtagctgggaagacaggcatgcaccactatccttgtttaattttaaaaactttttgtagagatgaagtctcactatattgcccaagctaatctcaaactcctgggctcaagagatcctcctgcctcagcctcccaaaccttctcccctttaattataggggaaccaactgcagttctcagaggtaacctgatctaccatctccccctggggctgtctcccccaccccaacaagctccccaaattccacctgggtggaatgcactgagctaggaagatggccctaaggagctagttgctcctcttcctctgggtacctggagtactccctgtgcacatctggagtagtgtattgttttagcgtttttgtttttttttttagacagagtctccctctatcacccaggctggagtgcaatggcgcgatcttggctcactgcaacctctgcctcccaggttcaggcgattctcctgcctcagcctcccaagtagctgggattacaggcacccgccaccacgcctggctaatttttttgtatttttagtagagacggggtttcaccatgttgttcaggctggtctcgaactcctgacctcgtgatctgcctgcctcggcctcccaaagtgctgggattacaggcatgagccactgcgcccgacttagtgttgtattttaattctccattcacttatctatgacttcatgagacttcaaggtccttactgtataatgcatgaaacatgaatgaataaaataaataagctgatttattcctctaattatacagtcaagagaacagaggtccagagaaactcagtgactcaagatcacagatggaggcaggcagagtagagatcagaagccaggttttctttcttttttttttttttttcgagacagagtcttactctgttgcccaggctggagtgcagtggcgcgattgtggctcactgcaacctccacctctcgggttcaagcatttctctgcgtcagcctcccgagtagctgggattacaggcgcctaccactacacctggctaatttttttatttttagtggagacggggtttctccatcttggccaggctggtctcgaactcctgacctcaggtgatctgcccacctcagcctcccaaagtgctggggttacaggcgtgagccactgtgctccgccagaggccaggttttctaatgccttgtccagtggcacttaatactaaactccatcagattctcagcacttcacagatatttccacactgcatatagcctttgggaactgttctagcctaggtttccttggtctcttgccaatcattgaatgcacaaaggcactaaaatggtgctgggtatcagaagcagccagattcaaactcctatcctagctttataatcttatggaaaccatttaactgttttcttttttttttcctttgagatggagattcactcttgtcgcctagattggagtgcaatggtgcaacctcgactcactgaaacctccacctcccaggttcaagcaattctcctgtctcagcctcccaagtagctgggattacaggtgcccaccgccacacccagtcaatttttatatttttagtagagacagggtttcaccacattggtcaggctggtcttgaactcctgacctcaggtgatctgcccaccttagcctcccaaagtgctgagattacaggcgtgagccactgcgcccggccttaactgttctcagttctaagtggggataatataagtcccttgtcggactgctggggggactacataacactgcacagagtgcctgatagtgcctaaatcacaatagatgctcggatgacttagtttcccttcattaagcccatagccattaccaagaaagccatcccacccaccaagatcaagtctattttgacgtgatatacaataacctcaaagctaactggacttggatcagagcagtcttaagggaaggaaggaaggaaggagggagggagggaggcggaagggagggagggaaggaggaaggaaggaaggaagaagggaaagaagggagggagggagggaggaagggagagaaagcaagcaagctaccctattttctttcttttctttttttttttttttgagatggagtcttgctctgttgcccaggctggaatgcagtggcgcgatcttggctcactgctacctccgcctcccgggttcaagcgattttcctgcctcagcctcccgagtagctgggactacaggcacgtgccaccatgcccggctaattttttgtatttttttagtagaggtggggtttcaccgtgttagccaggatggtcttgatctcctgaccttgcgatccacccacctcggcctcccaaagtgctgggattacaggcgtgagccactgcgctgggccaagctcccctattttcattatctcttctccaaattgatattaggcagaccaacattctcctcctattctagacttctaggttagcacctttaggtatgtaaatgtctgcatgactagataagatgtttaatttatgagtattaattgagtatttactatatgtaaagagtagaataagccttctttgctttgtggatcaagagttaattaagggatggctgggtgcggtggctcactcctgtaattccagcactttgggaggccttggagggcggatcacttgaggtcaggagttcgagatcagactggccaatatggtaaaactccatctctactaaaaatacaaaaattagctgggcatggtgccgtgcacctgtagtcccagctacttgggaggctgaggcaggagaattgcttgaactcaggaagtggaggttacagtgggccaaagtcgcgccattgcaatccagcctgggggctgcagtgcgactctgtctcaaaaaacaaacaaaacaaaaacaaaaacaaaaaaacacaaagaacaagagttaattaagggtaaactgtgaaaagcagcaaaaccagggcacaaatgtaggactacagctattgagagaaatgagagatcaactttaactgaaagagattctaaaaggccttcctctgtcacccagactggagtgcagtggtggatcatgatggttcactgtagcctctacctcctgtgcacaagcaatcctcccatctcagcccccaagtacctgggactacagggacctgccaccacacccagctaatttaaattttttttttttgtagagacacattctcactatattgctcaagatggttttaaactcctggcctcaaatgatcctcctgcccctcgcctcccaaagtgctgggattacaggcgtgtgtcacctcggccagttgatgtcttgtaaatgctgataaatagatatgggcttgggagtagcaaggaaattgtagggaaagaaaactgtttgagcaaaggcacaaagggggccaaagtgtgcagagtgtccagggaatgaaaacagatcagtatgaaacagcttgctgtttcttggctcactgcaacctgtgcctcccaagttcaagagattctcctgcctcagcctcctgagtggctgggattacaggcgtgccaccatgcccagctaattttgtatttttagtagagatggggtttctccatgttggtcaggctggtctcgaactcctgacctcaggtgatctgcccacctcggcctccaaaagtgctgggattacaggtgtgagccactgcgcatggccaatttttgtatttttttaatagagatgtgttttcacaatttttgttaggttgatatcaaactcctgagctcaagtgatccacccacctcggcctcccaaagtgctgggattacaggcgtgagccaccactcccagcctaggctaagaaatttgtactttttggccgggcgcggtggctcatgcctgtaatcccagaactttgggaagctgaggcgggcggatcacgaggtcgggagatcgagaccatcctggctaacacagagaaaccccgtctctactaaaaatacaaaaaattagccaggcgtggtgccgggcgcctgtagtcccagctactgtggaggctgaggcaggagaatggcgtgaccccgggaggtggagcttgcagtgagccgagattgtgccactgcactccaacctgggtgacagagcgagactccgtctcaggaaaaaaaaaaaaaaaaagaaatttgtacttttaaaaagtgttcaatttgtattataaattattttcaaagtacagaaaacttgaaccatggccctaggctaaatttgaccctgtgttctcataaataaagttttgttggggaataaccacatccattcatgtgagcattatccatgactccttttgtgctataaaggcagagttgcagagttgcagagttgcctgagaggctgtatggccacaaagtgttaaatattcacagtttggcctttacagaaaaagtctgctgactcaagtactagtgctatgaatgaccatagattctctacctagattcaacaatcgcaacaattgttagtattttgccatttttgttctatctatatgtgtgtctgtgtgtgtgttttctgatccatttgaaagtaaaccgccgatagtgatatgctagtaaattagttctcttgggggacaaaagcctgcatttgcagatttttgtggtataaatactcccattatggctgatttcaaactgccaagggtggtggggtcacacaattcttgaagatttaataatagcctgtgagtcgttaggacttggtttgggcacatcattggctgcaggatgcttcacccttgttttgacatgcatctctgaagaacattgtcctacataatcacaatactattgtcacagctaggaaagctaactagaaaaactaattagagaattcccggccgggcgcagtggctcacgcctgtaatcccagcacttgggaggccatgggggatggatcacttgaggccaggagtgagaccagcctggccaacatggtgtaaccccatctctactaaaaacaaaaattagcccggtatggtggcgtgcacctgtaatcccagctacttgggagactgaggcaggagaattgcttgaacacgagaggtggaggttgcagtaagccaagatcatgccactgcacttcagcctgggtgacagagtgagtgagaccatctcaaaaaaaaaaaaaaaaaaaaaaggagagagcattccctatttattttttgtttgttcaagtttccaatttttaaaaatttacactttttctttttattttgtcaagaattccctaatttttttttttttttgagatggagtctcactctgccactcaggctagagtgcagtggcgcaatctcagctctgcacctctgcctcctgggttcaagcaattctcctgcctcagcctcccgagtagctgggattacaggcatgtgccaccacacccgactaatttatgtatttttagtagagttggggtttcaccagattggccaggatggtctcgaactcttgacctcaacagatccatctgccttggcctcccaaagtgctgggattacaggcatgagccactgtgcccagccccgataattctggcacagggctgaattatctaacatttagtccaggtgtaaatttctccaattggttccagaatggcttttatttaaccatatttttaaactatgataaatccagttcataaatcacatttgtttgttatgacactttaatcttttttctgctatgacattgtcattttgaaagaccagcctgcactccagaatgttttacattctacattcccctgactgtttcatttagtttgttcctctatgagctttattcagccaggctaaactaaatatctgatgatagctaacagggtatttaatactatgataaaagggtaattcagattagggcaaaagagcaaccaggaggacatcacagtcctagaggatttaatttctcatacctgatgactattttactttagtcaatactcaactccagacttgggctcacagggctttgcataccaaggaggaacctgatagctttcatgtgtaaaatgcccaccagtaatgacttatcagtaatataatccttcatgaaaggtattattcctcactgacatctgtaaacactcctgctagctaaacataaactactgactccaaggaaatcctttagttatgataaaccataaatgaaactcatttttactgcaaactagaatgggcaataggtctatcttgaaaagaatgatcttgttctttttttttttttcttttttgagacggagtcttgctctgtcacccaggctggagtgcagtggcatggtttcggctcactgaagcctctgtctcccgggttccagcgattctcctgcctcagcctcctgggtaggtgggattacaggtgcatgccaccacacgcagctaatttttgtatttttagtagagacagggtttcaccacgttggccaggctggtcttgaactcctgacctcaggtgatccgtccacctcggcctcccaaagtgctgggatcacaggtgtgagccatcacgcccagctgatcttgttcttttttaaataaacgtgacaacagatacattaagctggggttcctaaacttgcctggccgtaagactcatgtggggaactttaaaatgcagatgcctaggcctctagccctggagatagagtctatcaggactgaaaaaaagggttcttaggtcattccagtgattagccagatttgggagtacctactcattggggcatgtattttgagtcactgtattttaagactgttgttttgggtttatacttaaaaaaaattttttttttaattatactttaagttctagggtacctgtgcacaacgtgcaggtttgttacatatgtatacatgtgccatgttggtgtgctgcatccactaactcgtcatttacattaggtataattcctaatgctatccctccccacttcccccaccccacgacaggccctggtgtgtgatgttccccttcctgtgtccaggtgttctcattgttcaattaccacctaccagtgagaacatgcagtgtttggtttttcatccttgtgacagtttgctgagaatgacggtttccggtttcatccatgtccctacacaggacatgaactcatcattttttatggctgcatagtattccatggtgtataggtgccacattttatcaatccagtctatcattgatggacatttgggttggttccaagtctttgctattgtgaatagtgccgcaataaacatacgtgtgcatgtgtctttatagcagcatgatttgtaatcctttgggtatatacccagtaatgggatggctgggtcaaatggtatttctagttctagatccttgaggaatcgccacactgtcttccacaatggttgaactagtttacagttccatcaacagtgtcaaagtgttcctatttctccacatcctctccagcacctgttgtttcctgacttcttaatgatcgccattctaactggtgtgagatggtatctcattgtggttttgatttgcatttctctgatggccagtgatgatgagcattttttcatgtgtctattggctgcataaatgtcttcttttgagtttccgtctgttcatatccttcgcccactttttgatggggttgtttttttcttgtaaatttgtttgagttctttgtagattctggatattagccctttgtcagatgagtagattggaaaaattttctcccattctgtcggttgcccgttcactctgatggtagtttcttttgctgtgcagaagctctttagtttaattagatcccatttgtcaattttggcttttgttgccattgcttttggtgttttagacatgaagtccttgcccgtgcctatgtcctgaatggcattgcctaggttttcttctagggtttttatggttttaggtctaacatttaaatctttaatccatcttgaattaatttttgtataaagtgtgaggaagggatccagtttcagctttctacatatggctagccagttttcccagcaccatttattaaatagggaatcctttacccatttcttggttttgtcaggtttgtcaaagatcagatggttgtagatgtgtggtattatttctgagggctctgttctgttccattggtctgtatctctgttttggtaccagtaccatgctgttttggttactttagccttgtagtatagtttgaaatcaggtagcatgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcttcttttatttcgttgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgcactttgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagtttccaacgggaatgcttccagttttgcccattcagtatgatattggctgtgggtttgtcataaatagctcttattattttgagatatgtcccatcaatacctaatttattgagagtttttttttttttttttttttgagatggagtctcactctgtcgcccaggctggagtgcagtggcgtgatctcggctcactgcaaactccgcctcctgggttcacgccattctcctgcctcagtctcctgagtagctgggactacaggcgcctgccaccacgcctggctatttttttgtatttttagtagagacggggtttcaccgtgttatccaggatggtctcgatctcctgacctcgtgatccgcccgcctcggcctcccaaagtgctgggattataggcgtgagccaccatgcccggcctttattgagagtttttagcatgaaggctgttgaattttctcaaaggccttttctgcatctattgagataatcatgtggtttttgtctttggttctgtttatatgctggattatgtttattgatttgcatatgttgaaccagccttgcatcccagggaagaagcccacttgatcatggtggataagctttttgatgtgctgctggatttggtttgccagtattttattgaggatttttgcatcaatgttcatcagggatattggtctaaaattctctttttttgttgtctctctaccaggctttggtatcaggataatgctggcctcataaaatgagttagggaggattccctctttttctattcattggaatagtttcagaaggaatggtatcaactcctccttgtacctctggtagaatttggctgtgaatccatctggtcctggacttttttttggttggtaggctattaattatcgcctcaatttcagagcctgttattggtctattcagtgattcaacttcttcctggtttagtcttgggagggtgtatgtgtccaggaatttatgcatttcttctagattttctagtttatttgcatagaggtgtttatagtattctctgatggtagtttgtatttctgtgggatcagtggtgatattccctttatcattttttattgcgtctatttgattcttctctcttttcttctttattagtcttgctagtggtctatcaattttgttgatcttttcaaaaaactagctcctggattcattgattttttgaagggtttttgtgtctctgtctccttcagttctgctctgatcttagttatttcttgccttctgctagcttttgaatgtgtttgctcttgcttctctagttcttttaattgtgatgttagggtgtcaatttgagatcttttctgctttctcttgtgggcatttagtgctataaatttccttctacacactgctttaaatgtgtcccagatattctggtatgttgtgtctttgttctcattggtttcaaagaacatatttatttctgccttcatttcgttatgtacccagtagtcattcaggagcaggttgttcagcttccatgtagttgagcagttttgggtgagtttcttaatcctgagctctagtttgattgcactgtggtctgagagacagtttgttataatttctgttcttttatatttgctgaggagtgctttacttccaactatgtggtcaattttggattggtgtggtgtggtgctgaaaagaatgtatattctgttgatctggggtggagagttctgtagatgtctattaggtccgcttggtgcagagctgagttcaattcctggatatccttattgactttctgtcttgttgatctgtctaatgttaacagtggggtggtaaagtctcccattattattgtgtgggagtctaagtctctttgtaggtctctaaggacttgctttatgaatctgggtgctcctgtattgggtgcatatatatttaggagagttagctcttcttgttgaaatgatccctttaccattatgtaatggccttctttgtctcttttgatctttgttggtttaaagtctgttttatcagagactaggattgcaacccctgccttttttgttttccatttgcttggtagatcttcctccatccctttattttgagtccatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttactggatgcagtttcttcctagcctcgatggtctttacaatttgacatgtttttgcagtggctggtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattgccccccactctctcctggcttgtagggtttctgccgagagatccgctgttagtctgatgggcttccctttgtgggtaacccgacctttctctctggctgcccttaacattttttccttcatttcaactttggtgaatctgacaattatgcgtcttggagttgctcttctcgaggagtatctttgtggcgttctctgtatttcctgaatttgaatgctggcctgcctcgctaggttggggaagttctcctggataatatcctgcagagtgttttccaacttggttccattttccctgtcactttcaggtacaccaatcagacgtagatttggtcttttcacatagtcccatatttctcggaggctttgtttgtttatttttcctcttttttctctaaacttctcttctcgcttcatttcattcatttgatcttcaatcacttgataccctttcttccacttgatcgagtcggctactgaagcttgtgcattcgtcacgtagttcttgtgccatggttttcagctccatcaggtcatttaaggacttctctacactggttattctagttagccattcgtctaatctttttttaaggtttttagcttctttgtgatgcgttcaagcttcctcctttagctcggagaagtctgatcatctgaagccttcttctctcaactcgtcaaagtcattctccatccagcgttgttccattgctgacgaggagatgcattcctttggagggggagaggcgctctgatttttagaattttcagcttttctgctctgttttttccccatctttgtggttttatctacatttggtctttgatgatggtgatgtacaggtggggttttggtgtggatgtcctttctgtttgttagttttccttctaacagtcaggaccctcagctgcaggtctgttggagtttgctggaggtccactccagaccctgtttgcctgggtatcagcagcagaggttgcagaacagcgaatattggtgaacagcaaatgttgctgcctggttgttcctctggaagccttgtctcagaggggtacccggccgtgtgaggtgtcagtctgcccctactgggggatgcctcccagttaggctacttgggggtcagggacccacttgaggaggcagtctgtccattctcagatctccaactctgtgctgggagaaccactactctcttcaaagctgtcagacagggacatttaagtctccagaggtttctgctgccttttgtttggctatgccctgccgccagaggtggagtctacagaggcaggcaggtctccttgagcagcggtgggcttcacccagttggagcttcccgctgctttgtttacctactcaagcctcagcaatggtgggcgcccctccaccagccttgttgctgccttgcagttcaatctcagactgctgtgctagcaatgagcgaggttccaagggcgtgggatcctctgagccaggcacgggatataatctcctagtgtgccgtttgctaagaccactggaaaagtgcaggattagggtgggagtgacctgattttccagttgccatctgtcacagcttcgcttggctcggaaagggaattccctgaccccttgcacttcctgggtgaggcaatgccgcaccctgcttcagctcacgctcggtgcactgcacccactgtctgacaagccccagtgagatgaacccggtacctcagttggaaatgcagaaatcacccgtcttctgcattgctcacgctgggagctgtagactggagctgttcttattcggccatcttggaaccacccccccccccccacttttttttttctgagacagcctcactctgacacccaggctggatgcagtggcacaatctcggctcactgcaacctccacctcccaggttcaagcaattctcttgcctcagcctcctgggtagctgggattacaggcatgtgccatgatgcctggctaatttttgcacttttagtagagataaggtttcaccatgttggccaggctggtgtcgaactcctgacctcaagtgatcctcccacctcagcctcccaaagtgctgggattacaggcatgagccactgcacccagccaggtttatactattctaaccatacttcaactggttgtctttgcaacaatcaaattaaaaccaacaagcgtttattggacacctatataacctaggcatttggtatatgctggaaatacagagaggaacacagttgctgcctcccaggaccacctgttagagaggtagtcacaggcctgtagaacagagagggttaagtagaacagtgaaggaatggacccatgaccttggttcttttttgttctttttttaaatacgcctttattttggagacaggtctcactctgtcacctaggctgaagtgcagtagcaagatcatagttcactgtagcctcaacctcttgggcttgagccatcctctcactttagcctcctgagtagctggcactacaggcacgtgccaccatgcctggctaatttttgtattttttgtagagatgggttttgccatgttgcccagaggctgatcttaaactcctgggatcaaatgatcctcctgcctcagcctcccaaagtgctaggtaacaggtgtgaaccatcacaaccgtccatgatcttggttctaatagccatagataaaagaccacaatttttttcaagttctttttttttctttttgagacagcgtctcactccatcacctaggctggagtgcagtggtatgatcaaagctcaccacagcctcaaattccagcctcaagcaatcttcccaccttagccttccgagtagctagggctataggcatgcatcaccatgcctggctaatttatttatttttattctgtggacatgagcatggcgggtggtctcatcatgttgcccaggctggtcttgaattcctggccttaagtgatctttccatctcggcctcccaaggagctgggattacaggcgtgaggcactgcactcagcctaaaaaaggcatttccattcctgccttcatctacattttgaatgggcaaagtccaagctgatgcatagaaagaactttccaaatcttcaagcccttatggcttgaagatcgctgtagtcataaacagcacaataaatacgaaaggtgaattaacagtcagtgtttaatttctctgatatagcactttagggcactaatataattaaatctctaattaagtcaactaaataattgtataagtgcagtatcacctgaaataaattaagtccaaatcccctgctaggggatccaattaaagatattaacaaagagagaagaggatacaaagtacttaaaattaagtgcattattatttaacatttattaaacaccttttgaatgatacatgttgctcttacataaaagaccctcttgagaaaatcactgtatgtctctgaaaactatgtagttcaaaagttctaaaagttcttttaaaatattaaagagaaggccccggcatgggttctgagtagtcttaggagaagtggaggcagcagccacttctgcccaaggaaactagagaaagactttaagacttaggagaggccaggaatggtggctcacacctgtaatcctagcactttgggaggctgaggcaggagaatcacttgaacctgggaggcagaggttgcagtgagctgacattgcgccattgcacttgagtcaaggcaacaagagtgaaactccgtctcaaaatacataaataaataataattttaaaaaagaggacaaaggagcattctgaaacacagaccagtgaatttatggagaatttatggcaaaacttcaaaaagggttgttaaacagatggtttgtgggctctagaaaaaaaggcaatggtggtggcagccccaggataagtgggtcacaataagcaagtcataataaaacacacacacacacattctttttttttttcttcttcttttttttttaaaatgtggccacttggctggtagcttcagaaataggatagagtggctgggcacggcagctcacgcttgaaatcccagcactttgggaggccgaggcaggcagatcacgaggtcaggagttcgagaccagcctggccaacatggtgaaaccccttccctactaaaaatacaaaaattagctgggtgtggtggcgtgcacctgttgtcccagctactggggaggctgaggcgggagaatcgcttgaacccaggaggcggaagttgcagtgacctgagattgtgccactgcactccaacctggcaacagagcgagactctgtctcaaaaaaaaaaaaaaaagatagagtaactttggatttttgaagtttagtccttcatgaataaggcagagaaacagggtacaggtcacagtatggtaagatagatttgaacatgtaaaataattattcctaggaaatgtttagtagtggatttatattgaacaggaaaacaggccaggcgcggtggctcacagctgtaatcccagcattttgggaggccgaggcgggcggatcacctgaggtcacgagattgagaccatcctcgccaacatggtgaaaccctgtctctactaaaaatacaaaaattagttgggcgtggtggtgcacacctgtagtcccagctactcgggaggctgaggcaggagaattgcttcaacctgggaagcagaggttgcagtgagccgagatcgcgccactgcactccagcctggtgatggaatgagactctgtctcaaaaaaaaaaaaaaaaaaaaaaaaacgcttagaacaggaaagcagtctctagtgtcatgctaccagaacttaatgcttggtttcttcttcttatcacgtttctatgcattacttgaatgaagatgaagaagaaatgcatattaaattttaattttcagatgtcacacagccaagagagataggtaacacatggatagtatcaaaattttaacggtattgacatgttgaacaaaagactgatagtagccagtaaaatctaacagggataattatatagttgtatatttaggtttcaaaaattaattgtaaaagtataagctgcaatttggcagtgactcatgaaaaatgttgagaatctttaataaccacagtcttggtatcagccaaggctgtgatgtaggtacaaaaaaatgcaaatgcaaactttggcagcatcagcaggtgtacatgtccaaaacacaggcaggaatggtctcacagcacacggacggtcaactaatgtttagaaaactattttcagtcctgggggccatgagtcaagaggggcactggcatgatagattgggtccagtattaggatgaagaaggatttggaaacatgtcacctagggaatgtttaacctggaggaagggaggatataaaagccatcttcaaatatctgaagtaattaaatggaagaaggaacagtcctgttctatgtgcttcaggggacagaacaaacagcaacaaggtaaagtttctcggaagaagattccacttataaataagaaaagaaccttcaaatgactagagttgtctaacaacagaatgattatttttgacaagctgtgggttccctattattggaagccttcagtgactggatgaccacatgtaggagaaaatatgactgaaactcttcgccagtgtgaaagataggacgacgctgcctctaaaggtctacccaagcccaagattctagctgatagtgcttaactgaaaggtcttgacagcttctgagtggcaagacttggtacaaaaggaaaagctacagttttctaatacaataaactgtgaaatgcattgcaaacaacataaaagcattcctttttactcagagttagaaattatttgcaagagtctataggaaaaaaaattcaccgatcttaattaaacatcttaatctgacaaaactagaaagagacaaagagaattttaaatagatttctcaatcatatgagattcacatgcaaaaatacagtaagaatagtagtgtttcccaatattagaaaagcaataataataacagcaatgacaataaagacaatctcatatatagtacttactgtgtgcccagcactgttctaagatctctctcttggccaggtgtggtggttcacgccaggaatcccagcactttgggaggccaaggtgggtggatcatgacgtcaggagttcaagaccagcctggccaacatggtgaaacctgtttctactaaaaatacaaaaattagccaggcatgctggcacacgcctgtaatcccagctactcgggaggctgaggcaggagaattgcttgaacctgggaggtggaggttgcagtgagctgagatggtgccattgcactccagcctgggcgacagagtgagactccatctcaggaaaaaaaaaaaaaaagatctctctctctctcgctctatctgtatctatacctatatctatcttctaccctcacaacagccctacgaggtagatgctactattattttcattttacaaaggaacaaatttaggtaagagcaagttgtccaaagtaacacagatgataagtgctggagtcaagatgagttcttgttcttaaccaatatgctatagtccctttctttcactcttaaacaaaccagaaagcattacaatttcatttgagaacataacacatacctatatcgctaatgtcctttgcatgcctatgtacaaggacagattttttaaaagatacatatcacagattagaaaaaaaatacctccagtcaaatagcttatgataaagccatatttatagagattgcagaaaattgaagccattatttaattatgtacctctactgcaacacatatatattttccaccaacctaaaaatgccatatggttgtagaacaaatgtcagtagaaattggaggtagaaattttccacattttctgctaagaaaaaggtcatgcatatctcaattgattaagtatattcttctggtcatacttttttgttgttgttgttaaacctaaaggcactgagcaagacaggtattatctcatccgccactgagtcacaaaacaaaactagtatatttttacttaaatccttaactaaccaaaacttatttttattaaaattatcaaccaaaggcactcactgcagtagtggtatttgtggtttcatgcagtgacaataccaaatattgccccaggttattttcactgcttttatttatttatttatttatttattgagatagagtctcattctgtctcccaggctggaatgcaatggcacaatctcagctcactgcaaactccacctctcgggttcaagtgattcttctgcctcagcctccccagtagctgggattataggtaagcgccaccacactcagctaatttttgtatttttagtagagacggggtttcaccatgttggccaggctgatctcaaactcccgacctcaggtgatctgccggcctcagtcttccaaagtactgggattacaggttgagcccctgcgcccggccaaaacatgtctatttttgaaaaatgaattcccaaatcatattgactatttaaaatgtattctattcccccttaacacacacacacacatacacacacacacacacacacacacacacaaatataaaagcatgtttagtatagtttttcttgccctgtcctccacgtttatcaattttactgttttctaatttaaaactgtatggctattatgcttagtctggatggtatgcagcctcctgttgggagtgagacttcagaacttatttcaaggctcaacctctctgctaagtacgtttgtgagttcacgctgtggcctgccatccacaaagagctgaacacaacgcaacagctcatttcgtacaaattatcataactgaacagatataaccatactactgtatatgtataaatactcctaaaccatatggtagggatacatttatatgatataaaatatatctacatcatataaacatgtttatatggtttagaggtatttatatatagtttaaataattttactggtacacttaaaattgacctaattgttgacagaatggcagagaagaactgagacaaagtagtgcttgctatgtcaaggagtgaaggtcaatttggatgacagagtgagaccctgtctcaaaaaaaaaccaaaaaaacctgcatttcagggtatgagcagacatgcctgctctcaaaatgtaattaaatgagacaaaatggacgaagtaattcttttttttttttctattttctttacatgtatctgctgaaacacgtaatgtaattctttttttttttttttttgggagacagggtctcactctcactcaggctggagtgcagtgttgcaatcttggctcactgcaacctctgcctctcgggttcaagtgattcttgtgcctcagcctcccgagtagctgagattacaggcatgtgccactgtgcctggctaatttttgtatttttagtagagacggggttttgccatgttggtcaggctggtctcaaactcaaactcctgatcccaggtgatccgcccgccttggcttcccaaattgctgggattacaggcgtgagccaccatgcgcagcctgtaattcttaatttataaacttgcatcaacatttgataggtttggcatttgaggttagtaatatagaattatattacatttaggattaatttcacaggaaaagcaatcactgcctcttggttgtcatgtcttccaaaggaatatttggtgatttataaataatcatggatttatccatattctgattcaaagttaatttttaattttagtatcatattccaaagagaaacttaattctacacattgaaattcaaaagcaaaactgggactgtaaagctttttagcaaactctgtaatagaaattcaacaagcaaaacatgtcataggctgtagactgcagcaatgagccactcttgcctgtagcttttttaggagtgaatcaataaatagtaagctctgtaatctcatgacaaatactaagctggttatttaattaaaaagaatactgtgggatgagagcattcacatcatgtaggaatcaaatagtcctgggggtatttgaggaatatataaactatgttaagagtgagtttcggtttctgttattttacttgaatccctatcttacttatacatttcttatatccttctcatgttccaattttcatgtgctttagtatttggatgctgatacctagggaccacttgccccaaactaccactatcatcatccatgtgatcctagattcctagcatcctaaaatacatcctgatataagatgagtttaaaacacatttataatttcacaagaaagcacctcaaacgacagagaaattctatctacatttattaatgaaataaatgtaggcttcagccacgtcttctaggtaggttgcatcagtgtgggggccaatgtatgaggtgaagaatgtatatttactctgtgccatgtaagtgtaatcatatctgcaagattaacagctcttccaaatgtaggaggtctctacgctatggtgttatggaaggtgtatttgttaacttagattgtgcctctttcaagagaatgatgatcagagtttgttttaaatggttattatctataaaactttcttttcaaaagtgaagcatgcttatcagcttaaagtcacaataattattacactggttcagcaaacataaatcctagcacagtcatttattagacaatcacatttctgagaccagaattatgttagattatagactaatacacaccgttttctggatgcttgcaagatcagagcctgaatacaacaacaactttttgtagtatgtctaaagcactttgagaagcaggatggtggtaaagaatacacactgctgctgggcgaagtggctcacatctgtaatcccagcactttgggaggctgaggtgggcggatcacttgaggacaggagttcgaggccagcctggccaacatagtgaaaccctgtctcttaaaaaaaacaaataacaaaagagaatacacattgtgaagtcagcagacctgagtagaatcttgaccctgtgagataattgtgtggacactgttaggttatttgagctcttctctataaaaagaggggattcacagaattcgatagaaccatttgattaaggtgtttagtgtgtgtcttaaacagtgtacgctgcaaagcacgcatacaatggcatgcatcttaaagaaagtacagcacatagaaaggtctacccatttttctgacagctgcacacaaatcttaggaatcaattaaagatacaggttagcataatcttcttagatccaggatagggagatcttccacagggggcaccattgcgctacacactaatcaatcttcagaggtacagctttggttttattatgatttagttaagatccttcttcttctttttttttttagatggagtttcacattgttgcccaggctggagtgcagtggtgtgatctcagctcactgctgcctctgcctcccgggttcaagcgattctcctgcctctgcctcctgaatagctgggattataggtgcccgccattacgcctagctaattattgtatttttagtagagacggggtttcaccatgttggtcaggctggtctcaaactcctggcctcgtgattcgcccgcctcggccttcttacaggagtgagccacagcatccggccttagctaagatctttcatcaagccagaatgtcaaggactcgggggaaaaggacagaatctactcacctacaatctttagtaacatttcacacttcactgagctatgctgcaggtcccatgatctctactgttacctaagtaattctgtttgaaaactgagggacatagccaccttgttatttcaggaaagatggttaagtacattatcagggatcaatactctgatgtggtaagtggggaggctgagtagtgcttggagacactgcataggaaatatagaggaatggcttcagatgtaccaactgaatcaactacagctttctgatggctcaaacagcttcaaatcacaaaaattcttaattcaacacaaaatccgacagcaggattagtgtatgactgtggaaatatgaatctaggtaacgatatcttctaacttactaaaactacgttcagtatctatacagaggtgcctctcttttcactcaaaaaccataattttgggaaacccatgcctctccactatattttatgacaaggaaagagatagtgttcccttcagatccactttaaaacagttttaatggactaaacaggcttttctatagggacagagggctctatcttcgacataaagacatacaggctctcctggtgcacaggtggcttctgacaccacaaactgggagcaataattgaatccagctatcccacagtgcagagcatccacccgcagagccagcctgaagggcatttctagttagctttccagataagactcaaaagattaccccaattgaatctctctgcctcaacccagggggtgagaggcattgaggatgtaatcatttgattaaaaatatacttggggggatataagaggaacaaaggtggaattaaatattccttatgaattagaagaacagaggttaggcaaaaacgcgcagtatcttgggtcatcattcattcattcattcgacagtcagtcaacaaatatttattgggtacctatcctgcaccaggtgctgtagtaggctttcacggtgcaatggtgagcaaactcaagacaccattccatgcttaccgtcaagaactggtcttcatcaacgatctaagcctgacttagcttcctgataaatattagatattatgtagatatgtaatttttaggggtcagtaatacaaaatggtaaattgaagagtgggagagactgccccactaaatattgttatgagctaaataatgtaaacttttacatatatcattttattcatttactttttatttatttatgtatttatatttggagatgatgtctcactctgtctcccaggctggaatgcaggggcgcaataaccgcaacctccatctcccggattcaagcgattctcctgcctcagcctcctcagtagctgggattacaggcatgcaccaccaagcccagctaacttttgtatttttagtagaggtggggtttcaccatgttggtcaggctgggctcgaactcctgacctcaggtaatccacccaccttggcctcccaaagtgctggaattataggtgtgagccaccacacccagccacatataatattttaaaccaagcatcaataaactaggaatatagaatctgaagaaaaataaaagagatttataactgcctatattaaattagtatcagtagtacttggggccgggcgcagtggctcatgcctgtaatcccagcattttgggaggctgaggcgggtaatcacctcccaaaggagttcaagatcagcctagccaacatggtgaaaccccgtctctactaaaaatacaaaatgtagcctggcatggcagtgggcgcctgtaatcccagctacttgggaggctgaggtaggagaattgcttgaacccaggaggtggaggttgcagtaatttaagattgtgccattgcactccagccttggtgacaagagtgaatctctgtctcaaaaaaaaaagaaaagaaaagaaaagaaaaagaaataagaaaaaaaaaagaaagaaaaaaagaaaattatggatggtcgggcaccgtggctcacacctgtaatcccagcactttgggaggctgaggccggtggatcacctgaggtcaggagtttgagatcagcctggccaacatggtgaaaccccatctctactaaaaatacaaaaattagccaggcatggtggtgcacacctgtaatccaagctactcaggaggctgaggcaggagaatcgcttgaacccaggaggtggaggctgcagtgaaccaagattgtgccactgcactccagcctgggtgacagagcaagactctgtctcaaaaaaaaaaaaaaaaaaattatttgggctaactgagagggtggcatgttatatgatgtcataaagatgcttatcattaaaatcatttaataattttattcatgatccacaaaggaatagagattatgataattaaatctgctgatgccactgaggtgtgtgggattgctaacacctcagagaacaagaatctaattttaaaataacattaagaaattagaggaacagataatcaaagcaagatgatagtcactggggacaaatacaaaataacatactgaaagagttaaggagaaaaaagactagcttgatgataggaatgaataatgtcgagagggcaaatgttttgcaaaagaccaaggctaataataaggcacaactctggtttaagatactaactattgcatgtgtgtataatttatttattttatttatgtatttatttatttatttgagacagagtctcactctattgcctgggctggagtgcagtggcacaatctcagctcactgcaacctctgcctcctgggttcaggcgattctcttgcctcagcctcctgagtagctgggactataggtacccgccaccacaccaggctaatttttgtatctgtagtagagacggggttttgccatgttggccaggctggtctcgaactcctgacctcaagtggtctgcccaccttggtttcccaaagtgctgggattacaggcataaaccaccacacccggcctataatttatttttgatataatgtttcacatggtacaaaagcttctataatttactgtaaacagaaactgatcagtgattatttttccatcattaataattgcaatttgaaggagatatgaaatcaaagcagtggttgcaaaaactgacaaactaattgttttgaaaaacagattaaagagaatctactcactattgctgcaaagaaaaacaggtgtctgaaatgtagttgccaagagaaaaataactggtttaatctggttttaaggaaatgaggagtgggggatttaaaatttttggacaggggctggtcatggtggctcacacctgtaatcccagcaccttgggaggccaaggtaggaggatcacttgaccccaggagtttgagaccagcccaggtaatatagtgatacctcttctctacaaaaaaattaaaaaattagctgggtgtggtgacatgcaactgtagtctctgctacttgcaaagctgaggtgggaggatcacttgagcccgggaggtcaatactgcagtgagccataatcatgccactgcactccagcctgggtgacaagcaagactgtctaaaaaaaaaaaaaaaaagttacatagttgcacccataccattatggtattttgatatggatttttttttctttaaattctactataaacgtcttatctaattatattacaagtcccttatggaacaagataggagagggcaatgccaatggctccacaatctccatagttatcactaaaatagaaatcctaaatgctaagacatctttggccaggtgcggtggctcatgcctgtaatctcagtactttgggaggtcgaagcggatggatcacctgaggtcaggagttcgagaccagcctagccaaaatggtgaaaccccatctctactaaaaatataaaaaatagccaggcgtggtggcaggcgcctgtaatcccagctactctggaggctgaggcaagtgaatcacttgagctgggtgcagtggctcacgcctgtaatctcagcactttgggaggccaaggcaggcagatcacgaggtcaggagttggagaccaacctggccaacatggtgaaaccccgtctctaaaaatgcaaaaattagctgggtgcagtggtgcacacctgtagtcgcagctacttgggaggctgaggcaggagaattgcttgaacccgggaagtggaggttgcagtgagctgagatcacgccactggattccagcctgggcaacagagtgagactccatctcaaaaaaaaaagagagaatcacttgaacctgggaggtggaggttgcagtgagccaagattccaccactgcactccagcctgggcaacgagaattaaactctgtctcaaaacaaaacaaaacaaaacaaagcaaagaaaaaatacatctttgcggggctagagaaaatgagagatttagtgcattcagtgatgttgtatggcatattttaccaaaaaagagctaatgtaaagtcccagggtaggagatgcagcatctgcccaagaaaggggtacaggaaagagaaaacacagcaacaactgttttctaaatgtgccaatgtgaaaaagtctcagagccagtttgctagggtcatgggaaggaactagcagcaaaaattgactaccaaaaataaataaataaacgaataaaggagtctggctttgtcagtaaaaaaagaacaatactatatacaaaaaatttctatattcaaggctcaaaaaagaaaattctggactcaatatgcagaaaaatggctgaagcatctatgtgtaataagaagaaatgactaaaagggcaaaccttggaaaggagaatcatgacatgagaagaaagacttttttctttttaaagggaagtaatgatatgtgatcatgcaaatgcaaatgtctgtggacattactgtttgctggtgggaagagaattttaatgtgtgctctatgcaaatgcattttataataaaacaaatgtgcaaggacttctgggggtgaagaggacagaggagagcagcagctgctaaatgctgatgtctgagaggcattggaggatagagccagaacgtgacactctggaaccctgagcaaattctagcagggaggatgagtcaaaaaccctatccttataaaaaatctcttacatttgacagagaactggatggctaatgaattaatatctggaagatctttttttttttttaccaagtgcttaagcatgagcaattatttctctgtgcttagaatgatcctcataagaggacatttaaaaaaccagcaaaaacctcccttttgtgtgttgagtcatgagacaaatgatatgaaatgcacaataaagcctagagaaagaccagtgcagagacagtgcacctgtagtcgcagctacttgggaggtggagatgggaggatctcttgagcccaggagttcgaggctgtagccactgcactctagactggacaacatagtgagaccttatatctaaaaaaaaaaaaaaaaaaaagaagaagaagaaggagaaggagaaggagaagaagaagagaagaagaaagactagagataaatataatgcaagctattataaactacttagtgtctttgtatcaaaatgagcgcgaatgtcaaagctcatttacggcacagtcctaggcactggtgaaagaatgaacagaaggcaggctctacaatgctgaacagtctggttttgaccaactgatggttattcatatctatatatctgaagcaattattaaaaagaaactgggaaaaagtctgtgtctctgtgacggagatatttaaacaagccattttgaaaatgttaaaaaattaaaattgtagaaagtcgaaccataggtgccatgttttgcctgaagtggtaaaaataccatctgcctcagtctttttagcagcatgcttatttcaagtagcagtaggctaaactacaggcatacgctcagctccagctggggaaaatacacagacgtttgtcgatgtttttctaagcaagagtagtcaacatattcgttttcttttagatatatatatattagttaccatggcaaaccaaacgtgaatgtggtccgagagccttctccaccagtcccaacacatctccaagaattcctacaattcaataggtggcactcttccctctagcactgagctgaagcggctctgcctaaccttgaggccagaagcctaaagagctggaacagtctgagatgtgcacctagggctgcaggacagtcactggaattaagatccccacagcattgtgcactggagcaaaagtgttagcttcctggtcacacttcacttctggtaattacattccatctaatacaacttctgcagttttaactaggtaagatattccttgtttttccatcttaaaagcgactaaggtaggattgccttacacagttaaacagcttccatctttgcccactgcccaggtgagtgagtttcagcaatgaggagagtgacttccagtgctgtgttaactactttaagagacagggagagatgtaatgaattaatagttgtcaagtgctttgatatcttaggatgaaaggtactacagcagtgtaaagcattcatatccaggctctatcacaacaggaactcaattaaaaagtaattcaatttctagctgagtgtctgtgtacagaccactattttgctgaatgagacacacatgttgaaggtccagttgagaatgattttaaaatgatcacctcttccacactctcccctactacctcaccatctgaaaccgacaaaattgagtgatgggccataaagccacagagtgcatgactgaaataattatatagttttttttttactctttattattttaagttctgggatacatgtgcagaacgtgcaggtttgttacacaggtatacatgtgccatggtggtttgtgcacctattgacccgctctctaagttccctcctttcgcgcccccctaccccccaacaggccctggtgtgtgttgttcccctccctgtgtccatgtgttctcattgttcaactcccacttatgagtgagaacatgcggtgtttggttttctgttcctgtgttagtttgctgagaatgatggcttctagcttcatccgtatccctgcaaaggacatgatctcatgcctttttatggctgcacactttcttgatatctgacttttcagacaaaatttggcttttgagtttacaaatacctatcacttggaaataaagaaatttccagcaataaatgaatttcacaatagtctcctgaaatggctgctgagtttttcaaatactattttacaaataactcctaccaggggaaccctaagccactaagtgtgatgcctatattagcctgaacatcatgaccacaaaaagcagagcacacaaagcagggaggagtagactttaggtcatgagatgcattgccaagagtccataacatactgcataaggcataatactgcagacatctccccaagacttagtagagaaagatataatctttcttctctatgttacttggatttaagtctgtttaaggctgacaggtctggattaactacctaaatcgagttatgtctttaaatatcagaatagcactacatattcaaggaggggtgggtttctatttactggcatgagaaatactattactgggcacttgaaaagacaaccttaggcaactttgggatggaatgtattacacagtcaatatactcttaaggcccggtgtggtggctcacgcctgtaattccaacactttgggaggccgaggtgggcagatcacctgaggtcgggagtttgagaccagcctgaccaacatggagaaaccccatctctactaaaaatacaaaaattagctgggtgtggtggcgcatgcctataatcccagctactcaggaggctgaggtaggagattgcttgaacccaggaggcagaggttgcagtgagccgagattgtgccattgcactccagcctgggcaacaagagtgaaactccatctcaaaaaaaaaaaaaaacctcttaaaatgactaatttgagtctacggtcctcgatcccagacctctcctaacctcctgtacgtctcctaacataacacgaatgtaatactcatgcacacatgtttgtcaagcactcctatgtaagcctgtgctagggagggtgatgcaaccatgagcaaggccaccgaagcacctgccgttagatcttttacatgctagtggaagaagaaataaacatgcacttaaatacaaactgataattttatgttatgataaatgttaaggagaaaaaaacagagcaaaggtggagtggctactttagatagggaagctggagtcaagggagcttgtgatggcaaaccctggcagtcgtgttcatgatggttgtcttggcactagcatagtgcctccaatatattaacatcaaataaaggctgggtgaggtagctcatgcctggaatcccagcactctgggaggctgaggcgggcagatcgctttgagttcaggagttcgagaccagcctgagcaatgtggtaaaaccccatctctacaaaaaatacaaaaattagctgcgcattggtggcttgcacttgtagttccagctacttgggaggctgaggctggagaatcacttgaccccaggaagcggaagtttcagtgagctaaggttgtgccactgcactccaatttgggtgacagagtgagaccctgtctcaaaaaaaaaaaaaatttaaatttaaaaataaataaatgtcggttgggtgaaggagtgtgtctggacctcaggataagaatgtctcctcccagatttagaatgggcctagggaatagaacagcactactctaaactgctcgttctgcactgaggaaactaagaaaagaccaaagagattaagtgaacaatttggtttggatgttttatcccctccaaatctcatgttgaaaagtggcctccattgttggaggtgggcctagcgggaggtgtttgggtcagggggtctgatccctcatgaatggcttagtgccatgcccttggtgacgagtgagttctcactcagtgagctcatgcatgatctggttgtttaaaagtgtgtggcacctcccctctcttgctaggtgacatgcccaataccctttgccatgtgccatgattctaagctcaccagaagcctaaccagaagtagatgtcagcactatgcttctcgtatacctgcagaaccataagccaattaaacctcttttctttttcattttttttgagacagggtctcactctcactcccgttgcccaggctggtgtacagtggcgtgatcacaactcactgcagcctcaacttcctggggtcaggtgatcctctacctcaggctcctgagtagccaggactataggtgtgcaccaccatacctagctattttttaatatttttagcacggagtgcagtgacacaatctcagctgactgcaacctctgcctctcaggctcaagcaatcctcccacctcagcctcctgagtagctgggagtatgagtgtgcaccaacatatctggctaatttttgtattttttttagagacaggattttgccatattacccaggctggtctcgaactcctgagctcaagtgctcctgccttggcttcccaaagtgttggccactatacccagacatatattttttttctttttatttttttagacagagtcttgctctgttgtccaggctggaatgcaaagacatgaccttggctcactgcaacctgtgccactggggttcaagcaattctcctgcctcagcctcccgagtagctaggattacaggcacgtgctaccacacccggctaatttttgtgtttttagtagggacggggtttcaccatgttgatcaggctggtctcaaactcctaacctcaggtggtccacccccatggcctcccaaagtgctgcgattacaggtgtgagccactgtgcccggccccagccaggtattttttattgcacggcaagaaaagactaacacagtgactgttaccagattttgcattgagttggtggcagagccattgcttggtccaggggtgctcttatttgtgcaccatatttttctctttgccattttccagtggaaatctcttccattgtcaagtgcttctgtgataagaaaccccagaggcattctttgagtcataaaaaaagcatcaccagtctgggtaacagcgagacctcgttccttaaaattaaataaataaagaaagaaagaaacaaataaaaaaaaatagccgggtgtggtgacacatatctgtagtcctagttacctgggagtctgaggcaagaggatcatttgagcccaggagtgggaggctgcagtaagctatgattgtgacactgcactccagcctgagtgacagagtgagaccctatctctaaaaaaaaaaaacaaaaataaccaaaataagcatcaatgttcaattgtcactcttttcccttatctttttattcatatgttagctttctgtcactaccacagtaaaaatcccagtctttatcttcaaactagtttactacaaccttcctaagcaatcttcttaaccctgctgatatcctcaaactgtgtcaaacgctttcctttcctctctgccttgagaaccaatgccctatcccccgattttctcctgcagcaggttgcttctccccaacttactgcgtgtgttttctattttcttactcatggcctctgttcactcgcttacttgctcattcactcgtcacttactaagtgtcaagtactgtgttgggtaccagatatactaagagaaaaaagaaactgtctctgccctccaagagctcacagtctaggatcagtctcataaatggatcattataatataacagagtaagagcagtgactgagaaatgcacagtgtattgaggaactgaggaaagcacctaatccagcctgggaaaccacagaggatttgctataggagacaatcccaaattaagcttcataggatgagcagagggagccagataaagacggcaggacattctaagcagaggggacagcatgagtgaaggcgcagagaacagaagcagtatgctttatgaaacttggtgctgctgcaggaccatgggagatgaagctggagggtctctttaggggagagatcacacagccccgtatatgccaacccagcaagctccgaatgtgccggatagacaacacagagcaatgaaggggtttttttttgagacggagtcttgctctgtcgcccaggctggagtgcagtggcgtgatctcggctcactgcaagctccgcctcctgggttcacaccattctcctgcctcagcctcccaagtagctgggactacaggcgcccgccaccatgcccagctaattttttgtatttttagtcgagacggggtttcaccgtgttagccaggatggtctcgatctcctgacttcgtgatccgcccgcctccacctcccaaagtgctgggattacaggtgtgagccaccgtgcccggcctagagcaatgaagggttttaagctggagagagaaacggtcagattggtggtttagacagccactctggctggtaaagatctgtggggacaaaagagaggcagtggagactgagcagtaggtttttcagtgttcagatgaagagactatgagcacgaggaatggaagagagaccaagaggaggagttggagtcaagaaaatgtaggctataaaactggtatgacttggtcatggaacaagaggtggggagtagaagtggtttctcacatggtaagtttctcacatggttgactggtgggatgacagtgctaatcacaggagagaggataagaaaaaaggctcagaggtccagcaccagggactgcaaccttcctaatgcaatatatggactttgggtgataacgacgcaccaatgtagactcatcaatttttttttctttgagacagggtcttactctgtcacccgggctggagtgcagcagcatgatctcagctcactgaaacctctgctcccaggcttaagcaatcctcccatctcagcctcccaggtagctgcaactacaagtgctcatcaccacacccagctaatttttacactgttttgtacagacagggtttcaccatattatccaggctggtcttgaacttctgggctcaagtggtcctcccacctcagcctctcaaaatgctgggattagaggtatgagccactgcacctggccttagattcatcaattgtaacaatgtgcttctctggtgtgggatgctgatggtgagggaggctgcatgtgtttggggtcaggggctataggaactctacttttcactcacttttgctgtcaacctaaaactgctgtaaaaaataaagtcattaaacaacagcaacagaaaggccagagatgtcagaaaagatgtttagtttagtttaagatgcactgggctctcatgcctgtgggagacccaagagggtaagtccacagcctgcgtttgggtatatgatgaggctcaagtacacatctaagaccgagtggcagatatggaagcccttggtttacaggtgctcctattatctagtttttcttgaaggaggcagataaaaggagagacggtcccaacactcctcatgggagggagagaaaggacttgacagcctctgagaccccaaaagctgcagagtctgagaccccagggaaaggcccagggaaaaagtcaaaaatcaaagaagaggcagtgaaggaaaaaaaatccttaactggggagaaaagacctgagacagactccaaaaaagccagagaccaagttatttgctgctcctagtaaatctgtaagaaaagcttcccacaccctaccgcaaatggcccccaaaccccaaaaaccaaagtatccctgtcaacctaaattcagtgattcaaccagaaggaaacatcagagctacctgaagaactttttagaaacactcaggtcctgacctgctttgcaaccttctccaagcgggagacccggacttacggattttttaaaacctccataggtaattctgacatatgttcctgggtataagaaccagtggttcaaagtaaatctattttgtaattgttaaaaaaaaaaaagagagactttattttcagcaaggaaagaagagtaaaggtgggggccatgggtgtgccccactaggctgccaggagagtgcgaggttccaggtcagctctggagaggcccttgagggttttggttgtcccacggcaagcagagcccttctgggtcatgtttctccctccctgtctttggagtgcaggtgtgctcacatcctggatattcctgattgttgcataaatcagatggttgacatgttcttttagccaagcagctgtacacatgccatacacctgctaaatgttccatttgtccctgaggggaaaacagaacgtgacccaagtgtgttcctaggcctgtactgatgcactgaaatctgacctcccgcagcagtttttaaccagggctgtgtgtcagaattatctgtggagacattttcaaaccactccagcctgcccctgtactgctctctccatcaggggattctgatcttggtgaaagagggtctgatgcagtggtacctaggcacatgtgttttcaaaagttccacaggtgatgtgagaactcctgcctttgagagctcaagtctatcctgtaaggtgctttctacttattatctgatggccctaaaggttgtcttccatccacaccccatagcatctttcaacaatagctagtgattttactgtttatttttcctcatcacatttgctgacacttgacattatttatttagtcctttattttgttattgattttccccactagaattgtaaatattctgaaaggaaagacttcatctagttgaccgttgtattctcaatacctaatacaatgtctggaatgaaacaggtactcaataataaatagacttcttgttgaatgaaccttattccacatgctattggcctgttacttaacaggaaatgtccttcagctctcaatgtgatcattctcttttgacctttcaaatataaacgaaagccaaacaccaaattgaaatgtgtaaaatagtacagtatgtataaaatctgcctaccttagcatagtccaatcttcctttttcttgagcctacaaaagaagaggggaaaattaatttgttacttctctaaaagtttagtgcttctataatttttgcttctcaaagaatagaactcagcttctctgtccccctttccctctctctatttaatatacatattgaactatatattataatccatgtaaattgcaagcatatagaaaagttaaacgaacagatcactgagcacgcatagacactacctagatctggcaggagtggatgtcacgactcttaatgtcacatgcttcagcatgtatcttatacatatacagcatctcatacatcaccccatgaccacaatcaaaattaatgaactcacaataatgccatatcatctaacacaaacctatattcaaacttcttcaactgttccaagaatatcttttatagcttttttccccaaaaccagaattaatcaagattcacacattgcattctggtttttgtgcctcttttgttgccttttatttattattatcatttcttcttttttgcctagactagtctctcccaatttttaacaaaatgaaaataaaagccatgcttcttttcataaaaaccattgactttttgagaagacaaggatagctgttttataaaatccctttttcttctttcttcattgcgtcatttaacttgtttctgttttgcttgtaaactgaaagttgggtctggagaaggctgctaagatttaggttaaacatttttggcaaaaatactttatgtggaaatattacatactccatcaattcaggaggcacaaaatgtcaggctgtttcactcttagtaatgccgtaaattcagctgggtgcggtggctcacgcctgtaatcccagcactttgggaggccaaggcaggcggatcacctgaggtcaggagttcgagacagcctggccaaaatggtgaaaccccgtctctattaaaaatacaaaaattagccaggcgtggtggcaggcgcctgtaatcccagctactcagaaggctgaggagacaagaaaatcgcttgaacccaggaggcggagactgcagtgggctgagatcatgccactgcactccagcctgagtgacagagcaagactccatctcaaaaaaaaaaaaatcttaacataacaaccagggttagtttttgctggcaggtcagtttgtgttttgcagacttcagaataaaatttctcctgccacttctgcatagaacaagagtcctccaacttacaaacgggttaggtctcaagaccattttgttcctgagtccaaatttacattatacaggtaattaacataggcagattacttccgtgagagaaaaaaaaagtttataatattggtcctaaagctgggcacagtggctcatgcgtgtaatcccagcaccttgggaggccaaggcaagaggattgtttgagcccgtgagttcaagaccagttgtggcaacatagtgagactccatctctacaaaaaataaaaaaaattagctgggtgtggtggtatgcacctgtagtcctagctacttgggaggctgaggtgagaggactgcctgagcctgggaggttgaggctgtagtgagccatagttgcaccactacactccaacctgggtgacagagtgagatcctgtctcaaaaaaaaaaaaaaaaaaaatggtcctgacccttcttgctgctttagaatcttttaaaaatttttctgaagatgactccatttttttttttttttttgagatgcagtcttgctctgtcgtccaggctggagtgcagtggtgtatctcggctcactgcaaactccccctccaaggttcaagggattctcctgtctcagcctcctgagtagctgggattacaggcacccaccaccacgcccggctaatttttgtatttttagtagagacaaggtatcgccatgttggccaggctggtcttgaactcctgacctcatgtgatccacccacctcagcctcccaaagtgttgggattacaggcgtgagccactgcgcccagcccttgtttttcttattttcatagtaagaaacttataaaacactgttcatgcacagttgttggcaccaccacaaaccactctaaaattgtgattaaatattttcagtgaaacaaaaggcctctgcaaccaatctactataaaaagagtaaggtcttcagtctgctttttgaagttttttagtgttctaggattttcagagaactaagaagagtttgaacttagtactgagatgcattgtaccaacaggaatatgagtgagttcttaaagaaatttcaaaaccaagctgttagtctctatgcttagatattttatatttattcgtttgtctgtttatgggcatcttttcccaaaatagttttgtctacactgaaaatcccaccatagtaacttctgcagaagtggtagggaagccctgaacacatctgtattgctcacttatgacctagctactcactttgatattgtccaaatatggactggccttgatcttacgaataatccacagatggcctgtgaccaaaatttcatcagcagcactttcccaacatgcttagtctttcagttctcaaactcgcagctgactcttgaattcatttaggttaatggacatctgacattgaggctgatcctgtggtcacaagttttccactttttccactctccatccttttccttgtcttttgctgactactatgaattgctcaagtgcagcacttttcaaatgacactaggatattctgaaatatatatttggtcatagtccagttttctggcatacaactcctaaaatcttcagaaactcaccaagtgatgcctttttgtatgttaacgagctgactgatggctggcaactcctgacttcaggatggggactggtcatggcaaagaccaagacaggattagaaggttagggctttcagcccacccccaaatttctggggaggggagaggggctgaaggttaacttgatcaccaatggccaatggcttaatcaatcatacctatgtaatgaagcttccataaaaacccaaaaatttgttccataaaaacacagaatttggagaacttctggggagctgaacacatggaggtttctatatggtggtacactggagaggaaatggaaaactccacgccccttcccacttgtcttaacttatgcatcttctcatctgtgttctttgtaatattctttaaataaattggtaagtataagtgtttctgttccaaaattcacatagctgtgaaaaagaaagtaagtgtttccctgagttctgggagctgctctagcaaattaactgaacccaaggaagtggtcgtgggagccccactttatagcaggtcaatcagaagcacaggtaacctggagcttgtgactggcatctgaaggtgggggtggggtaaggggggggtgcagtcttgagccctcaacctataggatctgacactatctccaggtagatcgtgtcaaaatatggtacgtgcctgttgtcccagctacttgggaggttgaagtgagaagatagcttacggtcaggagtttgaggctgcagtgagctatgattgtgcctgtgaatatcacttcactccagcctaggcaacaaagtgagacccccatctcaaaaaaaaaaaaaaaaaaaaaagaagtgtcaaaatagaagtaagttagagacactcagctggtgtcagcttgctgaagtgattgcttgcttgttgatggggagaaatccttgcatgttgggtcatagaagtgtcctgtgttgactatttttgagagactgtatcaaacacttttgagtgtgttttcttccactcacagaagcacaaactgggagtcctagagaattgttcctgaggtcaaacagctcaacactgagcacatctgtcatttcctcactgtcaatgttgcctctcttctaaccatctcctcttcatgctctctcaatattctcatcgttcagtgcttatcatgcggtgcttaagagtgttgaaagtagcatttgttgaaagttagaaagttgaacttctgtacttgaagactgaaaggcaaaccatggagaaactatgactgacaatgacttaggggtggaattttccttttggctgcattgagccacctcccactctgtctcaaaaaaattcaacaggtaagaagagtgaatataatattctttactgataaggacatctagaatagccctatcacaaattcctgtaaaaccatttttcccatcccatactttgtttatagactaatcatcttggaaaattctagtactttgaattacctgtgcttaatcacaacttatttgcaaacctcaaactctctcactttactttgtcttcttagcttggccactaccctgtcacccagtagggacacattgttggggatgacggcagagaaattccatggatataatctagatctgctcaacatcagctctataatgttttgaaagctgagagagtagaagcctacataaaatgacaacaccgttaccacagccattataatctgaacatgcaactattgatatgtggctcacccgaatatccttttcattttgtcacaataaatgttctagctctatgaaatcattttactcttgatcactttagcttgtacataaaagtatcatttattttaggaaaaaactctggtaaatatttaaacttctataggtatataatacatatatgtttccagctgatacatgggtataatatctaaatatgccaaacatacctgacaacagacattctgatatggtgttttctcacaaaaagctttagagcttttaaaaatatactgaccaggcacggtggctcatgccggtaattccaacactttgggagaccaaggcgggcagatcacatgagcacaagagtttgagatcagcttgggcaacatggtgagaaacctgtctctacaaacaataacaacaacaacaacaacaacaacaacaacaacaacacagcaaaaatcagccaggcatggtggcgcgcacctgtaatcccagctacttaggaggctgaggtgggcaaattgattaagtccaggaggtcaaggctgcagtgagctgtgattgcaccactgcattccagcctgggtgacagaatgagaccctgtctcaaaaaataaataaataaaaatatgtcaagttagatacaaataaatgatttagattcctacataaatgatatttctcattaaatactatccttattctttttgtaagatagttaatttgggagaagcgatagtttctattacacctcttggttgctcattcatttaacaaatactcattcagcacctactatgagtcagacactgcttaggcactacagacacaggcatgaacagaacagatcaaaatgtgtgacctcttggaatttatattctaggaggttacaaagtattgtgattgactgactgtttgattggttgattaaacagggtcttactctgtctgtcacccaggctgagtgcagtgctgtaatcacagttcacggcagcctcaacctctcaggttcaagtgatcctcctgcctcagcctcctgagtagctggggctacaggtatgtaccaccatgcctggttaatttttaattttttatagagatggggtctcactatgttgctcaggctggtctcgaactcctggatgcaactgatcctcctgccttggcctcccaaactgctgggattacaggcatgggccactgcacctacctacacaatactgttttagatatgcttcgtctacaatctcccaagctccatgaaagcaaggaaattttctcttgctcacaactgtatcccaagttgagatcagtgtctgagtgaatgaataaatggatgaagctttttctttatatgtattggttatgtactacttattcagggaatgtacaggaaaaacgaattttactcactcctagttctaggaaagctggatgtttttgtttgtgagctagtatgcaggtaatgtagagcccttagctgatgccttacatgtaatttttacccatatagaacaatggcatattttcattttctcacccaccttctatttataaatacactaaagaagggaacctaagcttccatctgtagaaaacaaattcaatgatttcatgaaaattaaccaacaaaaggctaggacagagaagaattagtgtaattaagtgcttcaaccttaaaagcagtgcgtctaaaggaaaagaccttagaatggaagttaacagatctccagagagatttcaagacatacacctcaaaatttcagggattaaaggccttgtctactgattacagcaaaaggcctaagatcttaattgtgaacacttcaagaggcattgtgacctgggaagatggatatgttgggagccagaaaatatggtttctagtccttcattggttaataacttgaataatttttacatttttgtataggccttcatttcttgatctgtagaacaccagaccagaccagaagttcccagatgctgggctctcacaaatgctgggctggatgtattggaatcacctgggtagcttgcgaaaaatgcagattctccatagcctacccctgtgattctgatttgtttgaggatcattggtctggcctatgtctaatgtcttttttaatttgtgcttctatgtgcatcagggtttacttcaaaggctgaaagagaacaactatgtaaactccataagtctcgaggagaatggactgcaacttttccctttttgttctgacacctgccacttatcatgtgtatttctagcagagcaagatattattattattattattgagatggagtctcactctgttccccaggctggagtggaatagcgtgatttcggctcactgcaacctccacctctcaggttcaggcgattctcctacctcagcctccctagtagctgggattataggtgcccaccaccatgcctggataatttttgtatttttagtataacggggttttgtcgtgttagccaggtagtctcaaactcctgtcctcaggtgatccgcccacctcagcctcccaaagcgttgggattacaggcatgagtcactgcggccagccagagcaagatattattaaaataactttctcacaggggcccaaaataggctgatataaaataaatggaatctatatttcaacagccagcagtcctgaacctcttcctgccacactgttcgtccccagaagccgctgtaaattctaccatacacagcaattccctgagggcttcattactagggtctttaaaagggattcactcatctttttgcctcctgtaggtgtgcttcttgtcaatccaggtcaagagaaaagaaagtaattttttccaaatctttagcagttcacagagaatgtgtggtttgaaccttgttttatcttttaaaaatgtgaaaatagacaagatagtgtgcctgtgctcatgacactggaggcctcctcggacagctatagtgaacactgtaaaacaatattccatacaaaagcaaaaaaaaaaaaaaaaaaaaaaaagccagcactctgattgagaggatgcacaaaggaattaattccaaaggtttatataccagtctctgtagactaaaggcagacagattccctgttggtaagtaatggatgtacaatgtggtcttttactttaagaaacaaacgtttttttataagtcaggtaacaaagaaggattggatgacataaatgaactgtttccaatttccaactactgttatctggagttgaaagctggatatggggacacctttttctaaaagcagaaaactaatattccacagcagggagtccagaaattgctagagactaatcatctctacttatcaggttattcttcccaaatgttacaggctatattttagaataactgccatttttaaagatttcctttttaaatcttcaaggaaaactaccttcccccgcaaactttttagttgaaagaatacaatgaacactcattttccctccacttagattcaacagttgctaacaccttaccacttctgttttccccctttctctccatgaccatttattatttgagagtaagttttagacataaggatgctcacccctagatacttcagcatttgtccctaagaacactgacatttactataatagttaattacttatttgtttgtctgacagggtctccctctgttgcccaggctagagtgcagtggcacaatcatggttcactgtagccttgacctcctggactcaagagattctctagcctcagcctcctgaatagctgggattacaggtacacaccaccacacctggctacttttaaaagtttttagtagagatgggatcttgctatgttgcctagctggtcttgaactcctggcctcaagcaatcctcccgccttggcctcccaaagtgctgggattacaggcatgagccactgcacccagccctataatgctatttaaaatacagttcaggctggccatctctgcaaaaaaaaaacaaacaaaacaaaacaaaacaaaacaaaacagtgtgtagtgtatggggataacagaaagaagggtcacaaatcagaaatctactacatctgctagcccggaagttagagcagcccactgagtattggtttggtagaagcaggccttgtgttgctcggctttctagttacagagctggaaagatagcagaatataaaggaacagggcaggccttttctctgctatcttggtcattctctatgaataagagagcgcagaaggcatgtgcaaggaagttaacaccattcacacctggactgctttgcttgggtacctgattttaccatctctttcaactgggaaagctaatcgacttttagaggcaagcgtggatgtctaaggaattaattttctcatattctgttcctttggttcactggagaaaaagaagcaacagcagatgtagaaggctatggtgtccaattttagaaaggagagaggcaaggagatactagatatactagagtaaggcgaggagatactacttgtattatctacataacaaatctctctctgctcagaggtcttgttatttctttgtaacctgtttttcttgctatgctgctctcttggaatctggaagaaacatgaaattttaaattgcacagtgtgaccaggaaaaaaaatcgactcaggtctcagaaaggccatgattaaggaaatcaggctaatagtagaatttagttgcttcctccagcagcaagttcccaaggcaacggccatcaaccttgatggagtacttcaaactcaccatgtcaagaacctaagttaaaccagtctttccacttaactttcctatttctattaatggcttaattttttctgttatcctagtccaaaatccttgttttagcctctgagtgccactccccagtccacacctgtcagcctctccctatcagatcagttttctagtcccatatattttctctgaaatgagttttacgcttaacctccttatcttcccattctcattgccaacactctgattgggcttttctcttgtgcttatcaatgggtttccaaaaacttcttaattgatctccttgcttttagtatctctttgttcctttcatcgtatataatatagccagatttacctccctcgcagctcagaccttgatcatatcaggctcaaaaactttcaatgtctgcttcatgacttcttcatcaagttggtttgccataggcaaacatcccaaagtcttttaaaaatttaggtaaaatttacataacataaaattaatcattttaatcatttaaaacagtataattcagtggcatttagtacattcacaatgttatgcaatcatcaccactaacaagtgccgaacatttttattaccccagaaggagacctgtacccattaaacagtctctcccgcttcgcctctccccaaccctgggcaaccaccagtcttttttctgtctctatgatttgtctactctggatgtttcacataaatggaatcatatgatatgtggccttttgcatctggcttctttcacttattataattttttttttttttgagacagagtctcactctgtccccacgctggagtgcagtagcatgatcgaggctcactgcaacctccgcctcccgggttcaagtgattctcctgcctcagcctcccaagtagctgggactacgggtgcctattaccacacccggcaaatttctgtatttttagtagagatggggtttcaccatgttggccaggatggtctcgatctcctgacctcgtgatccgcccccctcggcttcccaaagtgctgggattacaggcataagccaccgcgcactgcttataatataatgttttaaaggcccatacatgttgcagcatgtatcaatacctcattcctttccatggctgagtaatattccattgtatggatataccacattttgcttctccatttatcagttgatagacactgggctatttctaccttttggatattgtgaatattgctgatctgaacattcatgtacatatttttacataaaccagtcttttaaatatagttattactatttcagagcaattcttcatctgtccctgatactaccctatgtttttcacattccacccaaattaagacacttttttttaatttgacaacattgcatgcctgcacctgtatcactttttcatggtttcctttgcctaggaagcccccattctcatctttgctatccaatcttctttaaggactatctcacatattattaataccgacttcataaacctctttcttgacttttccaactgaacatcaattgtctttcctctatgctccccaagtggcatgaatcacagtattccttatgtttctatatttatgtatttatcttatctcctctctactgggccatagacaacctttaggcaacttatttctgtatctcctgtagtcaagcactttgtttccttaagtgcaacagaaagccttaagaaatattttaatttaggagatatctagagccatttcatagtctttgtggtcatgcatatagttctttcaaatgcctacattgtataccttctatgatagaggatgatattaatattattccttttgaaaccactaaaaatgtcttaaagaactagaagagtatcacatgtgttattaatgaggaatctgcatgtgcattttctcttttgtttaagaataggcatgtgttattttcacgcacaccagtcttgcctagcagtctttgttttactttctgaataaggagcaatagtaagctatctagggacaagcgagttacagcttagcaatggtaatttgtagtacacttaaggtatttcatgacagtgtcagaatgtcacaagcccaagtgacatttcagtactattaggaatagccaagaaaatctaaccataattcttatttcttcaggtgacttatagtggcagcagaaaactagaaggatcattaaaaataaagcttgctgacctgcaatagcccctggactccctgagagagtcagagctctgtggtgctctgaaggattctactttcttttattaggaatcaaaatgataactgagtaatgacttcacctccccagggtgaataacccattcactaacagtattttttcctgatcattatttctcagcagctacaaatttaaatttaaaattaaggcagggagagatctgtagaatttagtatggagaaaatgctcagcaaatgtttttcagctgtttccggtcttaactgccttttgtgaaagagtgtggttgtgtgcgtgtgtgtcaacatgcacatgcatccataggcctatagttgtgatggaagagggctacctaatcctaagatttttcaggagaaaggagctgctggagaagaggtggcacagcctgataaggaaaatcccaggggtgctcttgctcctagcttcacaatggtgctgaacgggtatcgagagtatgtcacctcctggcttccttgtctagtcaataattctcagtctttccaagcaggaaatcaaaacagtagatgagacacaaacctgcctgggcagagtaaagaagtaattttaaatgtggtaataagaaatcacaggtgacttccatcattgacagcaagatttttctgtttctcagtgttaaaacttgtaaaagtttctttttttgcgggggacagaatctcagtctgtcacccaggctggagtgcactggtgcgatcttggctcactgcaacctctgcctcctgggctcaagtgattctcctgtctcagcctcccgagtagctgggattacaggcatgcgccaccacgcccagctaatttttgtatttttagtacagaccgggtttcaccatgttggacaggctggtctggaactgctgacctcaagtgatccgcccacctcggcctcccaaagtgctgggattacaggtgtgagccaccatgcccggcctgtttctaatagagataaatatttttcttataatgcatctcttgtctaagagaactagttcttggatttattttagagctgaaagggactttggaaaagatctagtttaatgccatcattttacagaaaagaataatggggatatgagagaatgtgattaagtttacttagatgctagcagagtccaaattagaatctagaccaggagtgtccaatctttttgcttccctggaccacactggaagaagaattgtcttgggccacacataaaacacatgaacactaatggtagctgatgagctaaaaaaaaaaaattgcaaaaaaaccttcataatgtttgaagaaagtttatgaatttgtgttgggccactttcaaaactgttctgggctgcatgcagctcataagggctggacaatcttgatctgaccttccaaatcctggtcctctgtgggccatttctgttataccaacttaactctaacaaaaccgggctgccaccaaacagtctcaacctgcaagaccacaccacactcactttttgacaaatattaatttggtaattactccaagtaagccactgtggcaggtagtatgggtaattcaaagatgaatttgctattattgtttttttttttttttagacggagtcttgttctatcgcccaggctcgagtgcagtggcgcgatctcagctgactgcaacctccgcttcctgggttcaagtgattctcctgccttagcctcccgagtagctgggactacaggcgcccgccactgtgcccgactaattttttgtatttttactagagacggggtttcaccatgttagccaggatggtctcgatttcctgacctcgtgatccgcctgcctcggcctcccaaagtgctgggattacaggcatgagccaccacacccggcctgagtttgctattattgttaaggatcttgcaatcaaattcaaaactgaaggagagggctttaggggagggaaggaaaggatctcaaagatatccaggagggtaaataacatgaaaaaatcagaaagagaactaatttcaggattaataagcaacctccttgagatttagggtggaatgtctctcctaggtgttatgcaaattgtgttccctatttctgactaggaggcattcacagaacaagatggttatcttataaagctttacataaaaatgtacattacaatttagaagattaaaataaactcagtaaagtgtctttttttttttttttttttgtgagacagagtctcactctgctggccaggatggagtgcagttgtgcaatcagctcactgcaacctctgcctccagtgttcaagtgattctagggcctcagcctcctgagtagctgggattacaggcccgggccaccatgcctggctaacttttgtatttttaatagagatggggtttcgccatgttggccaggctggtctcaaactcctgacctcaagtgatctgcccacctcggcttctcaaagtgctgggattacaggcatgagccaccatgtccagccattatttttatttttaaaaatgtgttaattttcttacctctgtttttagttttctctgtctatgacttgtttttttttttttttttttttttatgaaacagagtttcactcttgttgcccaggctggagtacggtggcgcaatcttggctcaatgcaacctctgcatcctgggttcaagggattctcctgcctcagcctcccgagtagctgggattagagacatgagtcaccaagcctggctaattttttgtatttagtagagacggggtttcaccatgttggtcaggctggtctcgaactcctgacctctggtgatccacctgcctcggcctcccaaagtgctgggattacaggtgtaagccaccatgcctggccttttttttttttttttttttttttttttttaaagacagtctcactgtgtcgctcagactggagtgcagtggctccatcttggctcactgcaacctctacctcccaggttcaagtgattcttgtgcctcagccacctgagaagctgagattacaggcgtgcaccaccacacccagctactttttgtattttcagtagagacagggttttaccatgttggccaggctggtcttgagttcctgacctcaagtgatccacccccttggcctcccaagtgctcagattactgggattacagacatgagccaccacacctggcctgtgacttttttttttttttttggggacggagtttagctcttgtcgctcaggctagagtgcaatggcgcaatctcgctcactgcagcctctgccttataggtgtgcaccaccacgcccagctaatttttgtatttttagcagagacagcgtttcaccatgttggccaggctggtctcgaactcctgacctcaggcgatccacttgccttggcctcccaaagtgttgggattacaggtgtgagccactgtgcccagcctggcctgtgactcttaatagatacaaggtttcctgaaagagtccttagttttcttattttttttctttttttaaaaaatcatcttttttgtccacttttctgggagattttttcatttgtatcttccattcttctgattaaaaaattctgcaatcatatttttatattttataattctaatttttattcttgaattgtcctttttaatggatcatctattattataccatggatttaatatccttccttgtcaagtatattgattatagtgctttgaaaaacatctgcctttgattgcattgtctctatttccgctaagttccctttttatcagtttgtttttgacttgctgtttcgtggaagcagcttttctcaaatgcccagtggtcctcttttcctattctgcttcagagtaaggcagcagatattctgggcacttagatcctctgaggcttgtcaagtggtgggtcttgctgtaggaggactgctcagggatatgccatgtttactgaggaggccccaaatatccacatctgcaaggctttttctcctgagtttgacagtttcttcagaaagaaatcctccagttttctacttggtgaatatgaggaattttaagttggcagccagcattttgagaatcaataagggttgggaggagggaaatctttcagaacgcagatactcacttaggctctaagcttttttttttttttttttttaaatttcaaaaactttaattttgtagagatgaggtttcactatgttgttggtcttgaactcaagagctcaagtgatcctcctgccttggcatctcaaagtgctgggattacaggcatgagccactgcgcccacccatgctctctcctttaaggatggtggctacccccaccctcagctgtgcctggtttctctgtccagagcctcagattaacccaaccaattacagccacgaagttaaataaattccaagaggctttggctaaaaaggcaagaagttttgcactagagtttctgaattaaaagaaaaccaaaaaagttccctctcatctgccaaaatgagaaattcacccaattcaagcccctttacccctcccacttcgccatgcttttttcccccccgctttgataatgcctcagaacaagtattcagggtccaagtttgttttaaaataacccaatgagctgacagacggagctcctggaattctgcagcttgtgcgagagtccacagatgggaaattgcagtcagttatagggtggtgctattaccatagcccaatttttgaaagcctttagaaaaaaaaagtcatctgagttaattagcattcaccacaggcactagttttgtgttgcagtattctaagaactcagataatagaaaaattcagtactgcaatctctaactttaactaatcttttacctcttaaaaacgaagattacaaagaaaggattttacctgttacgtgaatatgcctaaggctcatctatagccatatatcaccaagaaatatcaattatgttctaaaatccactaattactactggtacctaaaacaggagtaatttcattttacctctccgatctgtttaatccacaaatctcttccaagaaattcctgatgtaagactacaggagctgagtttagattaaaagtcatggagtcactggtcttttctttaataaaaggctggacatcagaatttatctacaagaagcaattaaatgagtaaattagtgaaatgtatatacactagtatgttttagttatattcagaaagtaccagttaatgcagtgaaatatgaagcttaaggaatgcagtttttagatatactttaataaacaaaagaatatttcaggccaggtgcagtggcttacgcctgtaatctcagcagtttgggaggctgggatgggtggatcacctgaggtcaggagtttgagaccagcctggtcaaaatggcgaaaccccatctctactaaaaaaacaaaaattggggggggtttgcacacacattccagctactagggaggctgaagcaggagaatcgcttgaacctgggagacagaggttgcagtgagccgagattgcgccactgcactcccctctgggcgagagcaaaactccgtctcaaaaaaaaaaaaaaaaatttcagatgattaacaataacctgtaaaattctccagaattattccctaatacattccttttctagtgggtggtggtctttattttactttttaagttaaaggaaaagatttagataaagatttaataaatagaattgcttaataaactaatctaagattaaataaaatatgcaaaaagctcacctggagatattatatatgtatatattcccccccttatgaactatttaagtaacatctgaatagtatatattaaattaaatttaaaattatatatatagagagaggcaacaacacagcagctaatcttgggatattttagatttcatatgcccattcaaagaattagttattaaaattaaagctttcaattttattcactatatttctgaattttattaacttttcataacatgttttatataaagagctataaggggccaggcgtggtggctcacacctgtaatcccagcactttgggaggccaaggcgggcagatcacgaggtcaggaattcgagaccatcctgaccaacatggtgaaacctcgtctctactaaaaatacaaaaattagccaggcgtggtggcatgtgcctgtaatcccagctactcaggaggctgaggcaggagaatcgcttgaacctgggaggcagaggttgcgttgcagtgagctgagattgcaccactgcactccagcctgggtgacagagcgagactccatctcaaaaaaaaaaaaaaaaaagctataagggaactgtaacaaaaaagacaaatattcttccattatgtgaatatattccagtctgtaaatatgttatttaataatatgtaagagttctctcaagaaccctttcaggtgggaagaaaagacaaacatcacaaaaatggttcaagtaaactgtggctttctgtaagaattacacaatacttagcaattatactatttacattacataacaatcatccaggactgacagatttgaaccacacaataagcatttttgaaatataaaagaagcttattaaatggcaaaaggtttcttgtgtgtcgttttagctatttaagtactgaaaaaagataaagggtgtgcaaagtaccttatgactcatggccatgtgcttcccatactgaaatgccatattctgaacctcagcatcatgctttgctaattccattgcagcttggcagctctttgctagtaaggcaccatgggagagaaaagtctgctccttccaagtcgatattccaatatcatctgtgatataactttcctaaaaatgtaacaaaagccaagataaaaaagactttaggagtaatttaattgtttctgtttttgaagaataaaaaagttaagaaacgaactattcaaaaacactcaggctattggaacaagacagaactaaaagatgcctaacctcagctctacctaaaaagaatgtggtgggaaaactgcttttttatggtaatagggggaaagttaaagaaatgttaaagcaaattttattctaagctagggaacttctattaaaatataccctacaggataagggaaaaagtagaaagacttcaaactaactcccttctatagtcaatatcagttcttaagtgctggtattaagcacaagaagcctattgcatttaatttatgtgaaaatgtcaagggcatatggaaggaactacattttcttagaaataattaaatagaaaaataaggctgggcatggtggctcatgcctatagtccaagcactttgggaggccaaggcaggaggattgcttgaggccaggagttcgagaccagcctgggcaacatagcaagactctacaaaaaaaaaaaaaaaaaaatagctaggcaagggggtgtgcccctgtagtcctgactactcaggaggctgaggcaggaagatcacttgagcccaggagttcaaggttataagtaagctatgattgcaccactgcactacagccaggatgacagagcaagaccctgtctctttctctccccctctttttatttgagacagggtcttgttctgtcacccaagctggaacgtagtggcatgatcatggctcactgcagccttgacctcccgggctcaagcgatccttccatctcagcctcccaagtagctgggaccacaggcatgcaccaccacaccaagttaattttttgtattttttgtagatacagagtttctccatgttggccaggctggtcttgaactcctgagctcaagtgatctgccagccttgacctcccaaagtactgggattacaggcataagccaccacacccagataatttttttttttttttttaatagagatggggtttcaccatgttggtcaggctggtcttgaactcctggtctcaggtaatctgcctgccttggcctcccaaagtgctggaattacaggcatgagtcactgcgcccagtttaccctctatcttaaaaaaagaaaaagaagggtgggcatggtggctcatgcctgtaatcccagcactttgggaggctgaggtgggtggatcacgaggtcaggagttcaagactagcctagctaacatggtgaaaccctgtctctactaaaaatagaaaaattagccgggtggtggcaggtgcctgtaatcccagctacttgggaggccgaggcaggagaatcacttgaacctgggtgggagaggttgcagtgagtcgagattgcacccctgcactccagcctgggcgaaagagcaagactgtctcaaaacaaagaaacaaacaaagcaaaagaaagaaaaatcagagaagatgtaatctattataatggagaatgaatattatagtcttcatgaaagtttattctcataagaaacaaggtgtaaaagaggatataatttataaataaatatatacacatctaccacctctagaccaatgctgtccaatggaaatataatgtgaaccacatatgtaatgtaaacttttctagtggctatataaaaaaaagtggaaacaggtaaaattaatcttaatgacatattttatctatcccaatatatccaaatatcattttaaacatatattgaatatgaaaattattagtgagctattttacactttttttttttttgagatggagtctctctgtgtcacccaggctggagtgcagtggcgcgatctcggctcactgcaagctctgcctcccgggttcactccattctcctgcctcagcctctccgagtagctggactacaggcgcccgccaccacgcccagctaattttttgtatttttagtagagacggggtttcaccgtggtctcgatctcctgacctcgtgatccgcccgcctcggcctcccaaagtgctgggattacaagtgtgagccaccgctcccggcctttacactttttttatactaagttttcaaaatcactgtgcattttatacttacaacacctcactagccacaatttaagtgctcagcattggacagtagggctctgaggaaaggaatgctgaagcaaacatataaaaccatgttcattttatggcatttatttgaaacgtcaaactaactggaacctacccagaaggattaattaactcaatacacttttcttcctgctcctgatcctataatcctttctcttttcacaattgcttggagacaaaataaaaaatattaagaaaaaaaagtggtcaccaaaaggtcagctgaaatagagccccctcctcttctgccatgttgaggggcatcttcagcccactggtcaaatcaaattattagcttaacttcatgcaatgtttttgagatggggtcttgctatattgcccagactggtctcaaactcctgagctcaagcaatcctcccacctcagctttccaagtaactgggatcacaggtgtgtgccaccatgcccaacatcaccttaattttattaagtatttgaacaacaaaaaaaattccacttatggcaatggttgcaaatatgcaacacagcattggataatgacagaaaagccacacaggagagaaacaatgcataatgttaagaccttctttacaaaacattaggtataaattataacatacttaattttataaatctgagaatgtattttaaaatgtgacaatatatattaataaacctaagaaaaaccatattatctctccatatatactgcagaggtatttgacaaaattcaactcctattcttgatgagaaaaaatgtccagaataaaataggaagagctgggtgcagtggctcacacctgtaatcgtagcaactcaggaggctgaggagggaggatcacttgaacccaggagttcaaggctgcagtgggccataatcatgccactgctgtccagcctggatgacgcagtgagaaccctaactctaaaaaataaaaaaatagcaactgatgtgtatttctttaatgtgataggggtgtgtgtgtcagcccaaaagtcagcaaatattttatgaggaaacatgagcctttctcactaatgtcaggagtaagacagagatgcacacaacaccactgatatttacaatgtaatagaagagataagagaaaggtagatgtaaacaaattaggaaagatgagtttaactcttactgtttgaaggcaatataactgcatactgggaaaatcaagagattcaactaaaaaactactataaactagaagataattcagtaaggtagcagtgtctaaaattaataatttattattaacataataaattgtattaactatagctttcatacataaaaactaatcagtaagttttataaataggatcttttctttcattatgaatacaaaaataaaagattaaaaaactgggaataaggtcgggaacggtggctcatgcctgtaatcccagcactttgggaggcagaggtgggcagattacttgagtttaggagttaaagaccagcctgagcaacatggtgaaatcccgtctctaccaaaaatacacaaattagttgggtgtggtgtcttgtgcctatagtcccagctacttgggaggctgaggcaggagaatgacgtgagcttgggaagcagaggctgcagtgagctgagattttgccactgcactccagcctgggcaacaaagggagaccctgtccaaaaaaacccaaaatacaacaaaaaacccaaaacaaagaaaaaaacctaggaataaggccaggtgaggtggctcacacctgtaatcccagcagtttgggagggtgagggggcggatcacctgaggtcaagagtttgagaccagcctgaccaacatggtgaaacccagtctctactaaaaatacaaaaattagccgggcatggtgaagtactcctgtagtaccagctacttgggaggctgaggcaggaggatcactcgaaccagggaggcagaggttgcagtgagctgagattgcgccactgcactctaacctggacaacagagccagactccatctcaaagaaaaccaaaaaaaacaaaaaacaaaaaacaaaacctgggaataagcttagaaacgcgcaaaactgaatgcgcaaaactgaatgaagaaaatgttaaaatactattgcaggaacaaagataactcgaatgaatataaagacatatcatgttcaaagatagtaagatccaacctcataagttactccaataaaactaacaataccttttccctctgacactgggcaaactgaagttcatatgggaaaaataaacaaagaagagcagccaggaaaatcttgaaaaagaagagcaatgaatgtgtgtgtgttgggggaggggtggagagggacagcaaattttgtctaagccttaccagatactataacatgctgtaaaatctcagaaattttaaaaatatgtactttttagatagagagacagactagggagcaaaatagaaagtccagaaagcaaccaaactatatatagggatttgctatattttaggaagaagttgaacttttcagtaaatggtgctggtacaactaaagagctatctggaaaaaataaagtctgagctgcatttcgtactatttaccaggataaactctaaatggcaaaaacagcaaaaccaccacaaaaccacgggcaatgttaggagacaaaggacaatgaggaaaacaattcatatttcctatcacagacaaacggcgaatctccctgaggtaggctaacaatgctcaatgtttaagcaaagatgtctatatcctaatccctggaagctatgaatgttaccttacaaggcaaaagggactatacagatgtaattaaattcaggattttgaaatgaggggattactctggtttaactggatgggctcaatgtaatcatagtagtccttataagagggaggcacagtcaaagtcataaaaggtaatttaatgacaggagagagaaatttgaagatgagagatggggccatgagccaaggaataaacatggaaattagagaaggcaaggaaatggattttccaatagaactccaggaagaatacaagtctgtcaacatcttgatttagtgacttctgaccaataaaaaaaaaaaactctcagcttccctcttagtgatggtaaggctgtgaccaaataggcctctcaaatatggctggtggaagtggaaactagctggaaattccacaatctctatcaaaattataagtgaatttgccctgtgactcaggaatcccatgtccaggaattaatcctacagataaacctacatacatgcgaaatgaaatatgtacaaagtgtgaaagttgatcacagaaattgggtcaatcttgtcacacctgactaaaacagagttgagaagtcacaggaggaaaaaggacttagaatatgtaacattgctccaaaactgtaagtctctacaagcctggctgctcaagctgcctgctataatctcaaatcagttttatctaatagttgctgaaataacttgctgcaactctaagactaattttatccaccactatcattcactaatcaaaatctgccaactccccagaaccttactagtgcggatgaactctctcaaagagcaatatgtaacatttctccttttcataaaacctccaaccttctctctgttcttcagacatactaaagaccatttggtctgtgtgtacaccctgaattgcaattctttcctctcaagtaaactgttaaatttagatatttggctctctatacattttatttgactttgacaaaggttacagtctgttgttcacccaactgccagggtgacctttaaaaacacaaaccagaactacaatggcctccagctgttccaaacactctaggcatcacctcctagatgcctcttggcctctaggaggcctctgcacttgctgttctgcagatacactctctagacgtttgcatggctagatttctcattacttttgggtctctacttaaacttcaactcatctttaatagtctaccagcctcccccattatttcctatatccttaccttgcgttaaacctttcttccttgatattactggaccactcatatacttatttgttaaatgagttattgtctgtctcctttactagactataagttccatgaaagcaaggacttggtttggcctctgctgcacaatcagcatctaatatagtatcttaggtgggcaataaatatttgttgaattttttgtctttcttttggtatctctctccctcttttgtaccttcctctatctttcctaacttggtcagaataaagaattgaaataattctcctttaggctggatgcggtggctcatgcctataatcccagcactttgggaggccaaggcggccggatcacctgaggtcaggagtttgagaccagcctggccaacatggtgaaactttgtctctactaaaaatgcaaacattagctgggcctggtggtgggtgcctgtaatcccagctattcaggaggctgaggcaggagaatcacttgaacccaggaggcagaggttgcagtgagccgacatcacgccattgcactccagcctgggtgacaagagtgaaactctgtctcaaaaaaaaaaaaaattaattaaaaaaaaattctcttttaatgcctctctactgctcatagaatcaagatgaactctatagcatagcattcaaggcattcccttttatagtaccaagcaatacttctagtcccatctcctacacaaaatatcccctttgaggcctgaatttaacacacaggggaagttgctgtttcttgaataaaatacatattttcacacttgcgtgaatttattttatttatttttgtgatggagtcttgctctgtcacccaggctggagtgcagtggcgcaatctcggctcactgcaacctccgcctcccaggttcaagcaattctcctgcctcagcctcccgagtagctgggactacaggtgcgcaccactacacccggctaatttttgtatttttagtagagacgattttcgctatgttggccagggtggtctcaaacttctgacctcaggtgatccacccgccttggcctcccaaaatgctgggattataggcatgagccactgtgcttggcctacttgtgtgaactttaaatctaatccagatatcacttctttgaggagcgctctcaaatactaccacaaatattttcctctttagactaacattatcttatttatattatgacacagcagttaattctctctgaactgtatgatttcttatatgtttccttgaaggttagacctggtactagtcacttttatattttttaatcacttaggccatattcaagtttcaagtatttgctaaatgaatagtacctgtttatctgttgcattattaagtagatgtgtgcgtgtgttttaaatgttaaaagctaatgggtagatatggacatataatgacatgctattcagcaataaaaaggaattactgacacatgctatgccatggatgaacttcgaaaacattatgctaagtggaagaagccggacacaagagaccacatatttgtataattccattgatgtgaaatgtagattagtgattgcctggggctgggggtgggaactgtaaatgggcatgagggaccttataggggtgtgtgtgaaaatgttctaaaaatgatttggtaatgactgtatcacttgataaaagttactaaaaatcattgaatcgtaggcttgaaatgggtgaattttatgacataaaatatacctcaataaagctgttaagaaagaaaaaagctaatgagcataatattttacatttattggtctcaaatgtttaaattaacattttaaaaaatgtatgactctcaattaactgtggtttgcatatcatcctcatttattcatgcaaaaaaaacccatttattaaggttctattatggttcaggctttctgcaaagcaatatagatatgaagattaataaacagcctgtcctcaagaagctcacagtccagggatagaatgtatatatatcaatatatagatataactatatagatacagatatctatatatagaatgtatagataattctatttcagaataattgaaagatctctaaaatcaaagattcagttttgtttattacatatttcttactgtgattaagactttattattcatcatttctacattttaaattattcaagtaatacacgatcactggaaaaaaaatagaaaattcagaaaaccaagaaacgattaatttatagtcccctgaaatctactaccataagttaattggaccacaaattaactgttcctaagttaatcagaaattttattccctaaacattattaccttttatgagtttggttactaatgaaacaaaatccctcatttccatcagcttgccgtgtatatactaagagagcatgctctattataaaggaaaagttagtataaattgtaaaatgccaagaaactagtatgataaccacatccaaatcagtaccttcagataccagatatacagaattgtgaaatgaatgcatgttagtcagagtaaatgagatttagatatacctatatcaggacgggcgcggtggctcacgcctgtaatcccaacacttcgggaggccgaggcaggtggatcacgaggtcaggagattgagaccatcctggctaacacggtgaaaccccgtctctaccaaaaatgcaaaaaattagctgggagtagtggcgggcgcctgtaatcccagctacttgggaggctgaggcaggtgaatggcgtgaacctgggaggcggagcttgtagtgagccgagaccgcaccatggcactccagcctgggcgacagagtgagactccgtctcgaaaaaaaaaaaaaaaaaaaaaaaaaaagatacacctatatcatcaacttacatatgtgcagtttttactaaggtttattatacagaaaaggaggatacattcagtgaatatttacttttgacgggatttcctttttttttcctgaaaggtgatagatgtcaagatacttgttgaatgactatcagagagaagtatgttaattttttttaaatgtaggtctcactgtcacatgacctttttgctgaagtaaggctggttcaaataacatgggaaaaaaactgaaacttgcaagatgatgcttgcttgagatagtggtactggtggttttgctcagccatatgctgctctcctactttactgctccgagagatactttgagttgcttttctaatggtggtgagacatttgtacatatctactcacatgagaacaaactgcacttgtaacagtggctgctcaggattaaaggtctggtccatggtcacagaacaaaggtgaactaattggcccggaaaggtgtcaaagccccagcaagaacctgccaagccaaactgctacctttcacataatcagaaaagaagaggtggaaacaaagaagctagctgcctgtgaagttaaaagtactttttaaaaaagtatgcaaatgtcgcctgttttcatgcttaggatttcagattcatattctgggtcactatctttataaatacaacctaaatttgggttggatgagacaccagatctctctaatgacccatttcaccatgttaaatgtttgctttgaattagccttttcaattattttgagaaactggacagccaaaaatttacataccttattattttttttaaaaaaggtcaagtatagaaaaatgtctataaatctccacatttgggaatcagaaaaaagcaaggaaaagaatgcaatctaatatctcctgggagctaactatgtgatgacacttttatgttctttattataacagccctcagaaatattaattatcattattcccatttaataggtaaggagggccgggcatggtagctcacacttgtaatcccagcactttgggaggccgaggtgggtggatcacttgatgtcaggagctcgagaccatcctggccaaaatggtgaaaccccatctctactaaaaatacaaaaaattagctgggcgtggtggcagcacctgtaatcccagctactcaggaggctgaggcaggagaatcacttgaacttgggaggcagaggttgcagtgaaccaagatggtgccactgcactccagcctgggtgacagagcaagactgtctcaaaaaaaaaaaaaaaaaaggtaagatttcaagaatgtattttgaccaagattagaccgtagtatgtggcagagatgagtctcagaagtatagcaattggattccattttcttagcacataacagaatatatgcaatacttaatatatcttacggtttaaaagcaggttgtagactgggtgtggtggctcatacctgtaatctaagcacattgggaggccaacatgtgaggacagcttaagcctaaaatgtcaagaccagcctgggcaacaaagtgacaccctgtctctacaaaaaaaattttttttttttttttaagatggagtatcaccctgtcacccaggctggagtgcaatggtgcaatctcggctcactgcaacctctgcctcctgggttcaagtgattctcctgcctcagcctcctgagtagctgggattacaggtgtgcgtcaccacacccagataattttttgtatctttagcagaggccaggatggtctcgaactcctgacctcatgatccgcccgcctcagcctcccaaagtgctaggattataggtgtgaaccactgcgctctacaaacatttttttaaaaaattggccaggcatggtggctcatgcctataatcctggcactttgggaggccgaggtgggcagatcacctgagctcaggagtttgagaccagcctgggcaacatggtgaaactctgtctctaccaaaaatacaaaaaacaagccagttgtggtggcatgtgcctgtggtcccagctcctcgggaggctgaggtgggaagactgcttgagcctgggagggaggtggaggttgcagtgagctgagatcatgccaccacgctccaggatgggtgacagagtgagactccatctcaaaaaacaaacaaacaaacaaacaaaaactagttgggcatgatggtacatgcttgtggttccagccacacatgggaggctgaggtggggagatcgcttgagtccaggaggtcaaggctgcagtgagacacgttcaggccactgcactctagcttgggcagcagagtaaaaccctgtctcagggttgtagattgtatttaagagtgaatgacatctatgtacccgcccccgaccccgacccaccaagagcatttaaacttgtaaatcaagccctttaatattatccattgaagaaatcccagagtctagagcaggggtccccaacctccaggccatggactggtactaattctgtggcctcttaggaactgggctgcacagcaagaggtgagcggtgggtgagcgagcattactgcctgagctccacctcctgtcagatcagcatgggcattagattctcaaagaagtgtgaaccccgttgtgaactgtgcatgccagggatctaggttgcctgctccataatgcctgatgatacgaagtggaacagtttcatcccgaaaccatccccatgcattgagtgctgtattctaggtgtgcaaggatgaggtaaagtggggattgagaagcaacaacaatatgagctgctcaaaaagcgaaacaagatcactccttattgtggacaggacagttgctcatccaggatccatttctctctcctctccctgcttactaataaaaccgtaattttcttcaggtatttactgctcctgctaatgattaatttaggaaaggatatatcatccaattctagcctaagagatatgagggaaatccaccactgagctcctaggaaagacccacgtagaagtgggagttgtttcctctagatgttgccctgtcttgacaggacataccaagggctactgtagcttaactgctaccaggctgatgataaagacaacagtaaggaaggcagagcacggacagagagggcttcaatagtgctgagttgtcatgttaaactatccctgatgcctgactacctctgcatatacagttagagtaaaatatatatagagagagtaaaatatacatcttcacttatatgcacatctatttaattgggttttccatttttttgctgctgaaagcattccaatgaatttactccctaagataaaaaatggttacactatacgaaatctagatatgccaacattaacaactactagaacatgtaagtatttccttaggatggtgtattagttatctattgctgcaaaacaaactagcatcttaaaacaactgacatttattatttcacagtttctgagggtcaggaatccaggaatggctcagctggctggttctggctcatggtttctcgtgaggttgcagtcatgctgttggccacggctacagtcatatgaaggggctgaagaatctgctccaagctcaattaaatggttgtcggcagtaggctttagttcttgccacacaggccactcacgtgccatggcagctggcttccctagagcaagtgatccaggagagtaagaacacacccaagaaggacgaaggaagcttcactatatatatatttttatatatatatatatatatatatattttttttttttttttttttttttttttgagacagagtgtcactctgttgcccaggctggagtgcagtggcatgatcttgggctcactgcaacctccgcctcccgggttcatgtgattctcttgcctcagcctcctgaacagctgggattacagatgtgtgccaccatgcccggctaatttttgtatcactgtattggtcaggctggtcttgaactcctgaccttgtgatctgcctgccttggcctcccaaagtgctgagattacaagtgtgagccaccatgcctggccttcttcactatcttttataacctaatcttggaagtaacatgccattgcttctactctatattattggtcacacagatcaactctagtacaatgtaggaagggtttgcacaaggcgtacaaggaggtggggctaattgggggtgatcttggtggctggctaccacagatgaagttcgtgattagaattattggggtcaacagatctgaatatataaaaatctcttaaaacattctttcaaattgttttctagaaaaattcttttgatctgcatactaaccagccaagtttgagactatcttgccattaagtagaattattgtttcacttttcagataaaaagtgacacttcatttaaacttgggaagacatttcacttattagccatttgttcttcctcaatttattcatttattaaagattcactaagtataaaaaaaagattgactgaatatcttctatgtgcaaggtaagtactcatgccaatgagcaaaaccagagagttcttgctctcatagttattacagtctaatggggaagccaaacaattggataaccgcacaaagaaatataattatagccaggtgcagtggctcacgcctgtaatcccagcactttgggaggccgaggcaggaggatcatgaggtcaggagatcgagaccatcctggctaacacaatgaaaccctgtctctactaaaaatacaaaaaaattagctgggcgtggtagcaggcgcctgtagtcccagctactcgggaggctgaggcaggagaatagcgtgaacctgggaggcagagcttgcagcagtgagccgagattgcgccactgcactccagcctgggcgacaaagcgagactccgtctcaaaaaaaagaaatataattataaactgagatacttctgatgcaggaaaatgaacatacttctatgaccacatggaataaaagaacttggctgagactggggtttctggagatggcttccctgaggacatgacacttgagctgacaaaggaaacataaataaggggtaaagagtgaaggagatggaaaagtgtgttccaagctgcaaggatggcccatacagaggaggatgtctgtggatcagctattagggctgatatgcagacagtgagggtgagaatggtagaaagtgaggctggagggacagactgaggtcagactatgtaagcatcttttgggtcactttcaggattttggaatttttttttttttttttttgagatggagtctcgttctgtcgcccaggctggaatgcagtggcgcaatctcggctcactgcaacctccgcctctggggttcaagcgattctcctgcctcggcctcctgagtagctgggattacaggtgtgtgccaccatgcctagctaattttttctgtatttttagtagagaagtggtttcaccatgttggtcaggctggtcttgagctcctgatctcatgatccgcctgcctcagtcttccaaagtgctgggattacaggcttgagccaccgcgcccggcccagccaaacccagccttttttttaattacttttttttttgagacagagtctcgctctgttgcccaggggcacaatcttggctcattgcaatctccgcctcctgggttcaagcgaatctcctgcctcggcctctcaagtagcttggattacaagtgcccgccaccacatctggctaatgttttaaatatttttggtagagacagggttttaccatgttggccaggctggtctcgaactcctgacctcaagtgatctgccggccctggcctcccaaagtgctgggattataggtgtaagccactgtgcccttttttttttttttttttttttttttttgagacagagtctcactctgtggcccaggctggagtgcagtggcacgatcttggctcactgcaacctccgcctcccaggttcaagcgattctcgtgcctcagcctcctgagtagctgggattacagttgtgtgccaccacacttggctaatttttatacttttagtaaaggcgggtttcaccatgttggccaggctggtcttgaactcttgaccaagtgatctgcctgcctcagcctcccaaagtgctgggattacaggcttgagccactgcatcgggcccagagtctacttttaaagagagtgctccaaagagaaattccttctctgctccctcccagttatgcttctggtgaaggtggtggtacggaagagtaaggcaggcaccaggtgaacctggtaaggagcagaagtattaaggatgacttacaagtttttgacttgaaaatctgaatgaatggtgatgtgttttatgaagatagagaacaatgggatggcttcgaagggaaagatcatatatgtggtcttagatgtcctgagtctgagatgcctgtgagaacttcaagtggaggtgttgagaaaacagttaaatatttagctccagagcccagcagtgacccaggatggagataaaaattgggactcaccagcctatagacagatggtaattgaaggcttgggtttcattttctgaatggcttactcttgtcctttgatcagaatggtattctgttaaacactttacatgcctaatagtgatgttttatctctcaggcaaataaactgccttttaagatattttgctgtgatagttgtaagtaacctagagtgcctccaaatggtatacaaattcaatttagacatttaacaaataaaaacattcatcaactagatccactctaaatttgagggtctacttaatcaaaagggccactatacatactaagctttcttagtcaccaacagtttctctgccttctcaatatctatatcaaccttcactttaccactttgcatatttaatctaatactcctatatttgatttctaacatgtatacttcacaaaacatttgctacttttatttttttaattaaaaaagtttgctaggccaggcgcggcggctcacacctgtaatcccagcactttgggaggccgaggtgggcagatcacctgaggccaggagttcgagaccagcctggccaacgtggtgaaaccccgtctctactaaaaatacaaaaaattagctgggcgtggtggcaagcgcctataatcccagctacttgggaggctgaggcaagagaatctcttgaacccaggaggcagaggctgcagtgagcagagatcacaccattgcactccagcctgggtgacagagggagactctatctcaaaataaataaataaataaataaataaacaaacaaacaaacaaacaaacaaacaaaacaaattcctctcaatagtctttaaatctgaataagttcagtatttttacttgcatcaaacgatttatgactgtggttactttataaaaaaggatgccagtaaaattaaaggtatttattatcaccactagcatcttcaaagtctttatttgtgagtgacagaagcttgaacaaatgcccagcaaacaataaaacatgacatgacatgttttattagctcattaatacatgccttgggtacaatgtgagggacaggttgtgagtaaattgaccaatgaaatacacttcagagtatcttactgcttttacacagcactcattgttttacttttaaacctcttagaatatacacttttttaaaaaacagcttttacatgtatatataattaagacatttttaactccaaggaaaaaaaatacattttttcctatttctgtttgtttttagttttttgagacgttgtcttcctctgtcgcccaggctggagtgcaatggcgtgatctcggctcactgcaacctccacctcctgggttcaagcaattctcccgcctcagcctccagagtagctggggttacaggcgtgcaccaccatgcccggctaatttttgtgtttttagtagagacggggtttcaccataagccaggctggtctcaaactcctgacctcgtgattcacccgccttggcctcccaaagtgctgggattacaggtgtgagcaactgtgcccggcctcacttttcctatttctaatctactaaataaaactttcaatataaacccccttctactttggtagggtgaattagcttctttgaactcaaactcactgattccctctttctagtcgacgtcccctgcccaccttcatccatttttatggcaacagtctcaaagccccgatcttccattgttattactctgtgcttctgtaggcatacatgtacaataatgtctacatatgaacactgtagtcctctctggctgctggaggatctactatcatcaggaactctatggtaactatctggtccaggaagttcatgaccaactgactgactacttcagtggaaatacaacaaatggtaattgatgtcctttatccttggagggcaacagtacctaaggcagaaattcagagaaaatctaccaaaatctcactggatgttatatttgtatttggattcagagctcacattggtggcggcaagaaaactggctttggcatgatgtacgactcgctggattatgcaaagaaatgtgaacccagatatggacttgaaagatatagcctgtgtgagaagaaaaagacctgaagaaacaaaaaaactgagcaagaacagaatgaagtcagtcagggagactgcaaaggtcaaagttggtgctggcaaaaacaaggagtaaagattttgcaatgactttgtggtgatcctgcaaattcagtcaccacaaacgacaaaactgaaggaaaaaaaaaaaaaagccactgtaggtgcttcatgaacagccctgacatggctttcctgaaactccaagtaccaaacctttgccctctccagcctggggaggattgacattccactactaaatggttcctaaccctggagggtaggacttaggtcctcaggctagaagcctccagttaaactcttcaaaccagctccctaatctcacgcttggcctagaccaccagttccccacaaatctcttaatccatctgactccagtttactattgataaaggtacccccaaactcaggggcttcaaacaacaatcatttattatcactcactgtctttggatcagctgagattcagctaatctagactggtagctctgcctctcactgcacatctctaggttggctggagaggctctgctccaagggtctctcactcttcctggaccagcagactagccagggcatgtttttctcatagtgatgagaaaaacatgcccaagagagcctcttactggtcaaagcaagtgagcccagagttaaaggacaggtaagtaccccctgcccataatgggaggacattacagtgacatggcaaagggcatgaatgtgtacataagttatctactgctgcgaaaaaaatgaccccaaatttagtggtttaaagcaagagtaaaaatttattttctcacaatttctgtaggttaagaattcaggaggcggggcacggtggctcatgcctgtaatcctagcacattgggaggccaaggcatgaggatcccttgaacccaggagtttgagaccagcctgggcaagatggtaagaccccatctctatttaaattaaaaaaaatttttttaaagaattcaggaatggctaaactgggctgttttagcttggggcctctcatgacagactagaaatgctactttctgcaaagagacagaaatgaacctgtacaaataccctatactcctaattattatcaattactttttaaaccatatttttgtgcaatgcaataagtttcatgtgaaaatgctgttttggaggggcttagcatcaaaataaaagactgtgatatgcaaagaacaggttaaaagatggtagatgttgacttagttccacaaaatacacagtaagagagtaataaaacaggagacatcagttgtaaatgacttaataaattgaaaggtaggatacctgctgaactcctgcgcccttgccctacacttgtttccactgccaacaatctcgtctgttgcttcacacctgtttttatttcaacgctcctccagctggtctctctgcttctaatttctttggcttccaatttatcctattcacagcttctacataatctttatcaaagatcttactgtataagaccctatggttatttgctactgcttactattttaaatccaaattcctcaatacaaatgttcaagatctatccactgagttatttctcccttcaaaaattatcacctggctgggcgcagcactttgggaggcagaggtggatggatcagctgaggtcaggagttacagaccaggctgaccaacatggtgaaaccccatctctactaaaaatacacaaattagctgggtgtggtggtgcgcacctgtaatcccagctattcaggaggctgaggtatgagcatcgcttgaacccgggaggtggaggttgcagtgagccgagatggtgccattgcactccagcctgggcaacaagagtgaaactctgtctcaaaaaaaaaaaaaaaaaattatcacccttccctagtaaagccccagctccagctcctattgtacctttgtctctatctcagctctcaagacacgggtacctgatttgtctagcacagttgctagcacgtaataggtactcaacatctgttgagtgagcagtcctagagtaataactaaaacagagtaataactaaaacagaatgatagattcctttccttagttagatttacttgaacctgtgtccaaagcaccttcatgtttatactacatatattttcataacacctgtctgcccctctgaaattgaactactgcagcctcgaactcctggctcaagtgattctcctaccttggcctccccagaaactcttctattcacccaccatgctccatctgggtgggccttctttctattccttggacagattaaggcaattccttcctcaggcctttgctggagttgcttcctcttcctggaatgttttttccccccaacatagttagctgctttttgtcattcagatctcaacttaaatgttatttcctaaaacaggccttccatgaacatccaatctaaagtaactccttcaatccttcactatcatttctccctatttagttctctcctatacagttattgcttccagttatttctcttgttcatctattcatgtgatttcttgtttatagttggcctctccactgagatgtgagctccatgggggcaaagatgtctcattcactgagcacttgtatttccagtgcctgccacacagcagatgctcaaaagacacattaaatgaataaacaaatctgacttcccagctaatgctcaatgactatttcctgatcccaacaaacttcaatagtttctttctttcttttttttttttgagacagggtcttgctctgtcacccaggctggagtgcagtggcgcgatctctattcactgcagcatcgaccccctgggctcagcctcccaaggagccacaggcatgtaccaccatatctagctaattaaaaattttctttgttcagacagagtctcaacatgttgcccagactggtctcaaactcctgggctcaagcaatcttcctgccttggcctcctaaagtgctgggattacagatgtgagccactgcgctgggtccaatagtttctattgattcatttctactgtatcttctaaggactcagctttaaaattacatcttccaagaagctccctctgaaacattttgaattcttaatgctgcactttctcctacatatatagtctgttccttacaattttacatgtggtcttatgggaaaattgctctcctgtggcttcatgtgcatgtatttcctatgacctgtaagcatcatcagattcttgagggctggcctgtgttctttattgctttgttttgaatgttccaggagtactcaatatgctactcttcacacagcagaaattcaatacaagattactaatatacactttaccaaaactgcctaatatagctctatgggtactataggattcatgataacaaacaatttaattagaatccagtgagaggccaggagtggtggctcatacctgtaatctcagtgctttgggaggctgagatgggaggatcacctgaggccaggagttccagaccagcccgggcaacgaagggagaccttgcctttacaaaaattaaaaaaaattaggcaggcgtggtggtgtacaactgtagtcctagcttcttgggagactgaggtgggaggatcccttaagcccaggagtctgaggctgtagtgagctatgattgcatcactgcactctagcctgggtgacagagtgagaccctgtctctgaattaataaatataaatgtaaaaaaaaaaataaagactccaatgagaaacaattaatctagaatttccagagcctagtgtagtggcacatgcctgtagtcccagctacttgggaggctgaggcaagaggattgcttgaggctaggagcccaagaccagcctgggcaacatagggagattctgtctctaaaaaacataaaaataaaaataagttatctgtatcattagtaattatataatgaaaaactcagaacataatatattttctcttttggtgttacttgggaagaaactgtgtcaaattcaaagtccaattacagtaaagcctggtagataatcactccaacttcctttccatattctccaattctccattctatttttatctttttttttttctttttttctttgagacggagtctcactttgttgcccaggctggagtgcaatggtgccatctcggctcactgcaacctctacctcctaggttccagcgattctcctgcctcagcctcccgggtagctgggactataggcgcgtgccactatgcccggctaattttgtatttttagtagcgacggcgtttcaccatgttggccaggctggtctcaaactcctgaccttaggtgatccacccacctctgcctcccaaagtgctgggattacaggtgtaagccaccacgcctggctctatttttatcttactagatttttttttttttgtctacctaaaaatatttgcctatcagtctacaaagatgaattcccaaatcatctttctggagctctttactctttcatctggagagtctgccagcacctcaacattaattcaacctcaactaaacttatctgcttctctctaaaaccagtctttggctggcaactatataatcatgttttctggtcaattagatgcaaaacattggtgtcatttttgatttcttattcccatggccaatgtacccaatagacacactaaacatgcacttagggtaccagcaatgcaatagcaccataaaatttataggagggaaatgttttatttgttatttttataaaagtcattataacataaatttttaaaagtcctgaaaatcagcacttccagccaagatggagcaaaagaggtgaggttttctttcttgcttgaaagagctaaaaactgaagaaaatatatgaaacaaaagttataagccatttgaaatcaggcaacaaaagacagtgacacccaagaaatgggaaataaatgagatgagtttcataattgttctagcttctgcctggagagaatgccaggatgcagaggaaactacctttgagttgaaaaggtgaacctggatgtctagagaagccgaaggggttaattaggggctagggttcatagggcagagtacacaagaagagagagctgcagagagagctctgaaggtaaacacagatcctccctaaagtcttcggctgagtattgccaatgcataggtacaaagaaactactaaagtccagggaaagaatcacccagaaggaacagcagaaacaatccctagagatcacacagggctgggaataattcctgttccacaagtcagagtaaaaaatttcaaaattcatagggcatcagtaaagaactcagaaaggtctcgctttaatagtgaaaaaaattggccttagactaaatgctattccagtcctgcctaataaagcttaaaagtgacacctgaaagaatcaaactgttttcagtaacttaactacattcaagaagaaagttcaagaatatttatagtgatacaaaactatctagcatccaacaaaataaatttcacaatgtctggcacccaaccaaaaataaccaagttgcaaaaaaatagggaaatacaacccataatgagggagaaaaaaatcagtcaattgaaaccaacccaggaaatgacacagatgatataattagtagacagggatattaaaacagttttcataactatattccatatggccaaggagctagaagaaacactgagcatattaagtagaaacacagaacatgtaaactggtctgcttgaatgcacaccaactgaaatgatccaaaatgaatcacaaatactaaaaaagaagaagaatcagtgactctgggacaagttaaagcagcctactatgtaattgaggtccctataaaagaggataaaaggaaagtcagaaaaaaaaattgaagaaataataatcttttccccgttttatgaaaaccaactcacagaaccaagaagcccagtgaatcccaagcaaaagaaacatgaaaaaaagaacatgaaagcacatgataatctatttatgactacaggaacaaagataaagatggcagtagctttcctgttgaaaataataaaagcaagaagacaatgaagcaacatctttaaaaatatggaaggaaaactaaattgtcaacctagaactctatatccagtgaacatatatttcagacacacaaaagctaaaagagttcattactggctggacgcagtggctgacacctgaaatcccagctactcaggaggctgaggcaggagaattgtttgaacctgggaggtggaggttgccgtgagctgagattgtgccattggactccagcctgggcaacagggcgagactctgtctcaaaaaaaaaaaaaaagagttcattactagcagacctgtcttataagcaaggttaaaagaaatcttttaggaagaaggaaaataatacattctggcattacagatcttctaccatgcgttataaacacctacttttgcaatattacttttcactgttcctttacttctatgtgaaggaagccctgatctcaaatatgctttctttccattcatcatgctatttcctctacttggaatgccatacatctccatctatagacatcttcccaatctttaatgtccatctcaaatgtaacattctttttgatgccttttctgatttccccaactagatgtgagttcttgttcacattaccctcctgttatttttcttaatgggaaaaaaatcatttggctctttttactatgttttagatggcagcacagggctttgcaggtagaagacagtccttaacttcctagtggactgaattatcttttttttttttttgagacagggtctcgttctgttacccaggctgaagtatagtggcatatactcactgcagcctcaacctcctgggcttaagcaatccttctgccttacagcctcccaagtagttgggactacaggcataccaccatgtctggttaatgttttaatttttgtagagatgggttcttgccatgttgcgtaagctggtctcaaactccttggctcaagtgattgccctgccttggtctcccaaattgctaggattacagatatcagccatcactcctggcctcttttatttatttatttatttatttatgagatggagttttgcttttgttgtccagactggagtgcaatggcatgatcttggctcagtgcaacctccatctcccaggtacaagcgattctcctgcctcagcctcccaagtaactgggattacaggcacccacccccacacccagctaattttgtatttttagtagagacggggtttcaccatgttggtcaggatggtttcgaactcctgacctcaggtgatcctcctgccttggcctcccaaagtgctgggattacaggcatgagtcaccgtacctggccctggcctcttatttttatactttacttgaaagctgcctgagagcgaaaggaacataagcataaagaaaaacaaatgggccaggcacagtggcttacacttgtaatcccagcactttgggaggtcgaggcgggcaggtcacctgaggtcaggagtttgagaccagcctggccaacatacactaaaaccccacctctaataaaaaaaatacaaggcgctgtggtgcatgcctgtagttccagctacttgggaagctgcggcaggtgaatcgcttgaagccgggaggtggaggttgcattgagccaagatcgcaccactgtactccagcctgggctacagagcaagactccgtctctgaaaaaaaaaaaaaaaaaagaaaagaaaataaatggacagaaggacagaagttatcttgccccacaaaaacataatgatattcatcattataatccactgactgatactgaaagtattaatataatccgtgcttgaaaaaaatagatgggatctttgcaacttaagtcacttgctaaaaccagttctttcccaagagaactggattctcttttaaaaccctctcactttcctgagactgaggccaagccaataagagctgaacctctggagacaggaaagaggtgtcttgttccccatctcaacaccaacatgagtcagagacactgcctttgcagaggaccttgattaaattccccaggaaggatcaggagtgggtggaaaataaacaataaaaaatcagaaaatgagtgtgttcgggatctccaaatcacccccaggtttgatgatttgttaggatgacagatgttactcagcatatagtcaaattcatcgtaatgacttttttacagtgaaaggatacaatgcaaaaccactaaaaagagacagccccatagggtgaagtctggaagaaaccaggtgtaaacttctaagaatcccctctcagtggagtcacgcagagtgtgcttaattcctccaagaatgagctgtgataacatgtatgaaacattgtctaccacggagatttactggagactgacttagtggtgagggtttttattagggctggtcatgtaggcattttctgcctagcatgtagcaaaattccagactcctataaggaaagcaggtattcagtataaaccatattgtctgtaaacagtttaggcactgcgagccattcttatcatttggaggatggtaggaacactcctaaaatccagcttctccgatgctagccaaggatcaaccttataagcaggtttttctcaggacagtaatccttttctgcacagaggtatactgaaaatactcttcttgatttaagaatctcactttcaggatttttttttttaagcaaatagtatgaaattgagcaaagttatatacagtaagatgttatcacaatattgtttaatttagtaaagaaaactggaaacaggccaggcactgtggctcacgcctgtaatcccagcacttgggaggctgaggtgggaggatcacttgaggttaggggttcgagaccagcctggccaacatggtgaaaccccatctctactaaaaatacaaaaattagccgggcatggtggtacacacctgtaatcccagctacttgggaggctgaggcaggagaatctcttgaatccaggaggcaaaagttgcagtgagctgagattgtgccactgcactccagcctggatgacagagagagactccgtctcaaaaaaaaccaaaaaccaaacaaaaacaaaattggaaacaaagtaaatgcccccaaaatgtgaaattgttcagtaaattacagtataacaatgtgaagaaatattaaacaatcattaaaattatatttttgaagacttttaatgacaaaaatgattatgctgggaagtaaatcaatatgcaaagtgttatatacagtaacaactcaaaattgggagaaatacagaataaaatctagaaagaaatatactaaaacataatcatgattcatttctggggaatggttttataaaataatttttattttcctcttgacctttttctgttttcaattattatttaataaacatgtactctacctttttttttttttttttttttttttgagacagagtctcgctctgttgcccaggctggagtgcagtggtatgatttcggctcactgcaacctccgccttccaggttcaagcgattctcctgcctcagcctcccaagtagctgggattacaggtgtgcgccactatgcccagctaatttttgtatttttagcagagacacggtttcaccatgttggccaggctggtctcgaactcctaacctcaagtgatctgcccacctcagcctcccaaagtgttgggattacaggcgtgagccaccgtgcctggcctatttttctaatcagaaaataagttaaaatgataagacaattagaatttagatatacaggtctgtgaatccaaagtcaattttgtaaaaatgtaaaatatttagtgagtacagtaagtaacatgagcgtaatatataaaacagcttaactggggaactcttgaccatttaaaatgcaattttccagctgagcatggtggcttatatctgtaatcccaacactttgggaggctgaggagggagggtagcttgaagccaggagttcaagactaatttgggcagtatggtgagaccttgtctctacaaaagttttaaaaaattagacaggtgtggtggtaggctactgtggtcccagctattcggaaggcaaggactgcttgagcccaggagttcaaggtttcagtgagctaggatgacaccactgccctccagtctggatgatagagtgagaccctaccttttttttttttttttttttgaaactgcagtctcactctgtccaggctggagtgcagtggctcaatctcagctcactgcaaactccacctcccaggttcaagcgatcctcctgcctcggcctcccgagtagctgggattacaggcgcgcaccaccaagcccagctttttttgtatttttagtacagatggagtttcgccatgttggccagcctggtctcaaactcctgacctcaggtgatcagcctgcctccacctcccaaagtgctgggattacaggcgtgagccaccgcacctggctgagaccctacctgtaaaaaataaaaatttaaaaaaaaaaaagcaatttttctatttcaaatgcttctttcttcaatgagctaacatttaaaaagcagagaggggagatattttcttataaacactaaagaaagcagaatggctaatttttattataatgagcaaatggttcacaaactagccaatgcaaaaatgaaaatatatttcaatggatagaacaaaggatgaatttcctaagctattttgtatgtttatatagctgtaattcaacttacttagtacagtaagtatgagtaagtaatagcactttgggaggctgaggaggatgggtcgcttgaggccaggagttcaagaccagcctggccaacatggcaaaacctcgtctctactgaaaatacaaaaattagtgagacgtggtggtgtgtgcctgtagtcccaactacttgcaaggctgaggcacaggaatcgtttgaaccgggtaggcagaggttacagtgagctgagatcgcgccactgcactctagcctgggcaacagagcgagactcggtaaaaaaaaaaaaaaaaaaaagtattagtaatataagtcatgtacattttcacagctttaaggagaattaggtaattgctctacaaacctcttcttcttctttttttttttttttttttttgagacggagcctcgctctgtccccaggctggagtgcagtggcgagatatcggctcactgcaagctctgcctcccgggttcacaccattcttctgcctcagcctcccgagtagctgggactacaggcgcccaccaccacgcccagctaattttttgtatttttagtagagacagggtttcaccgtgttagccaggacggcctcgatctcctgacctcgtgatctgcccgcctcaacctcccgaagtgctgggattacaggcgtaagccaccgcacccggctgctctacaaacttcttttggagaaggtgacttctaatgtatccagttccaattcccttgcattttttgctatgcatctaccttagtcacatatatgctatttaacagaaagctattttcctactacccaggatcttcaccactgcattaagctgccatatagaaaacagactgctattgtatcctcttacccctagaaagatgaaatggtttgcagcttcttttaaatcacaaaaaaattcttttgtgtactaaattggcccaaggctacggaggttgtgcaacagagatccacagaggagcctctcttcccacatgacctccacttgtggctgcttcccagtcctgccagaacatgaaaaccttgaaagcactccatgtgggggcagtgctctctctggcatctgaagtacttcttgcgctgttagaaaaaacaaattctgaagagccattgcaatggtaagcacactcaggaaaaaaagccagaatttttctggttaggaagggaaatgtggttaacctaaattggacctgaggcacaaatggaggcatcaagaagcactcccactactacagttcaactatgcatttttgtttccattctttttgaaaaaattattattattattattattttgagacggagtcttgctctgtcgcccaggctggagtgcagtggcgcgatcttggctcactgcaagctccgcctcctgggttcacgccattctcctgcctcagcctcctgagtagctgggaccacaggcgcccgccactgtgcccgcctaatttttttatatttttagtagagatgagatggtctcgatctcccgacctcgtgatccgcctgccttggcctcccaaagtgctaggattacaggcgtgagccaccacgcctggccaaaaattattattttttaagagacaaggtcttgctgtcacccaggctggagtacagtggtgtgatcacagcttattgtaacgtcaaactcctgggttccagtgatcctcctgcctcgcctcagcatcctgagcaggcatgggctaccatgcccagttattttattttttgtaaagatggggtcttcccatgttgtccaggctggtcttgaactcctggccccaagagatcctcctacctcggcctcctaaagtgctgggattataggcttgagccaccacaccattctgtttccattattaaaaaagaatggccctttaaatggtttggctattttcagaaatttaactgcttaaaaaagggctatgaggaggtggcagggaaagaggacagatgaatgaagcagtgctataaagtctctttaataaaatgtagctaatgaaggttagcattcctctgaatctctgtatttaaataaagtcagcaattggtgcttgctaagtggtggttcaagtacaatcaacagcccttcaaagactttgttgcttcttcttttctctttttcaggaagaaacacattaaaaatattagaaaaagcatgggactgagagtcaagaaaaacctgggttcattatgaactgtgaaacatgttaatatattaacaaataattttcagacactatgctttcctgccatttgttatgtttgaatttcaggcttttcctctataaatgggaataccaacaaatgtcacccttttcataggtgattgtgtacaaagaaagtataagcaaactgtaaagggctatctaagtattaactgtcgtagctgtcaggtttccctgacataaaaaatacttaaaacatggtcacacaattattaatgaactgagcttattatagtggacaaatggtaagagtagataaattaagaaccttaaaaccaacaataatgctttcatgtaaaaattaacatatttaattgtgaaatatagatatcttatatggaactaagttgaacactctggaaatatcccaagggaaaacagtgtctcaacagccagaactggtcactataattatcatagagtgggatctcaggtatggcagacagatgctatcaaatcaggtttcactaaagtacagaagatatgggagcgggtacggggaagtgctgggtagagaaaggcaggtcctggctggggctccactcctacagacctaggtgaggacaggcactcctgcttttgtgcctaactgttgcattttccaagaccactgtggtctgccatgcccccatcctgggctgggcatggtggctcacacctgtaatcccagcactttgggaggctgaggtgggcagatcacctgaggtcaggaggtcaagaccagcctgaccaacatggagaaaccctgtctctactaaaaatacaaaattagccaggtgtggtggtgcatgcctgtaatcccagctacttgggaggccgaggcaggataatcgcttgaacccaggaggctgaggttgtggtgagccgagatcgtgccattgcactccagcctgggcaacaagagcgaaactccatctcaaaaaaacaaacaaaacaaaacaaaaaaagagtctgggctcttgacttcaaatccctgagagctaacaagttgtgtgaccttgggaaaattacttaaccttttctcaaccccagtgttcacatctgtaaaatggggatagcagtagtacctatctctcaggatttctgtgaggattaaatgaagaaacacaggcaaatcacttactacagggttatttgcttagctgttgtcatcttcatcatactatctatacaacgtaactttttacaagtggaactagaccagtagtcacccattttacaatcagatattaacctccatccatagtagtgaacttgcatgtctttgaaaggtccactgtggtcatccatcctgtgaggtctctgcataccaatatgctgcttaggtgaggccagatgtgcctactaggaactgtggttacttgaaccaaacgttggcagatgtccaaagtgcaattcttcatattctaaccagtctctgaaccacccagagtccctgggttatacttttaaattttaaatttcttatccaagttactcatgccctatgtttcacttctaataaaatttatcttccttttttcaaatgaaaatgtcaaaaagcttaagatgtgcatatgtgcataccttttctaatttgaagtgagtgaaatcttgctaatacagaagctaaagaagttagaataatgaaacactaagataggagccccttataatagtatctaccatgttaaatgatggtgatggtcaatgaagcaattacttcacatctaacatcctaccgaaatgaaataactgcattttaaggaaatgaaacctaacctttcttgagatgtcctgctaaatgagtcaaaaaaatcttaattctagacctataaaattaatcaaaataatccaactgtgcaatcatcccacttcttataataaagaatctaataatgcagtaaattatgcatcttgtatataaaagatacccccatcccacctccccaacagtcatcttcttaggctcaaggtccactcctctgtgacacggaaggacccttcctctggggaaaggatgggctcagctgcctcagcacgagctgctcctccagcctgcctgcctgtgacactgctacctgctagccagaagcatcccagtgtctactgagctgctgcagattgaacagactgtgaatccagccagaggataagaggttgttttaattggctaaatctgctatgtagtaagcgtatggccatgaatttgtagccaaaacactaatcaaaaaaaaaaaaaaaaaaaaaaaaaaagccatgtacaatttaaacacaaaacaagaatgacattttcgttattctagttgtaccacgacggtttataacataacattttatgactctgaaatcctttacctttgaagtagaattttcatgatatactccttgtaccaagtccataagagcacttgctaaaagttccacaacctaaaaagcaagaagaaaaataaaaataaaaaaatttaaatatatctctattgttacctcagaatgtttcagaaggctcagtggcaaggcagaatttttctgtgcttgacagaaaaaatgggactatgcaccaagatctcagcaaatggcattgcccacctggatattaaagctgtgatccaaattttttcagtcataattcaagccaaaaaaaatcttataagcatagcatttaactaatatacatgaaaatcgagtaatagccattttgaacataaacttacatttcagataactaatgaaatcttaactcaatttattttctgcatgtttatttctgtcaggtggatactttttcagtactcccattctgggagcaattacaatgttaattttcatacttattacagaaaaaaaagcaaaagcaaaagaatggataatctttcaaatatgttcattctgttacacttaaaatgcactgtggatatatttactgtggggtccctgggtcaaatgtaccataaacactgaaaatttttacagaactgtaatactgaaatcatattcatcaaacctgtattatttttcaaggctgagactttttttttttgttaaatcaagtgagatcaaaagctttgaacttgttccaggatgtaaaacaagcagaaaacagtaaatggtctctttggaactactgtacaatttagagtagtttgcataaagcatcttaatttgagaggataaaatagtggtatttatgataatgttcaatgtagccatttcaaataagaattcctcaaggcaaccccatccgcttcttacaagtcttaatatcttgtatatttaacttcctatgttatgcagtcctgtatcagatttccactctttgcttccgaaaattcagctccattctgattgaattaaaggattttgtttcagcttttatcattcttgtaattgaagacattattaagccaaagaatacagacccaaacaacaagatacttcaatctcaggtaccctgggtttaataaacattttcttagaggcaaatgacattaatttgtagaaagatttgctttaacattttaacacatgagcacttatctccaaatttatatatttacgtttatactacataacatacacagaactgctgatatgaaatttttgctgattaaaggcatatttttttcctagctctttaaggatggtttaatttgtaagacatatacaaagtcttttttattttttttaaatcacattgtccttcaggtaaccaaatacttaagaaatattgtagcaatatgagctgcagaggaactggaaggacaatgatcctacagtgttaccacatgagttgagttatttaagtggggaagagagaaaaatgaatggatttttttccccctgaaggtatcagataagccctattcctaaatccaggaggactgagtatcgccaataggtctatgaaagactgtaactaaacgcacagcatcagattggattacagtttacacaagcaacatcccaagatccccctgatggctggacacataatacagatcaatcactcactaagaaatgttatggttttgaaacagtttgagctctgagaccagcattggtaacgtgaagagggatttacaaagagaaagtctgacgctaaatgtcaaaatgatggcatgaacttttaacagtggatctggctctggataaccagagtgttcctttacttccctgaaattccagaccaggcagaagcaacaagaacattttgttctctgactctttttctcattgcgtaaacctgtccttacaagttcataatttataaatgacctgtacttacaaatggctatacttacttgaacagaacacacctccacctccatagccaatgacaacccattaaggaaaaagctttagatttctttgagttaacaagtcgaggaaggaaagagattataaaaagcaagagtagcctaagaagttgaaactgttccagataagggtgacttacccagtgcacatatcaatctctttacattgcctgaaatgtttatttttaaaattataccaaagaaagatgtgtttggtcgggtgcagtggctcacgcctgtaataccagcagtttgggaggcagaggtgggtggatcacctgaggtcaggagttcgagaccagcctggccaacatggtgaaaccctgtctctactaaaaaaaaaaaaaaaaaaaaaagacaaaaattagctgggcatggtggggcatgcctgtaatcccaattactccggaggctgaggcaggagaattgcttgaacccaggaggtggagtttgcagtgagccaagatcgcagcgccactgcactccagtttgggcgacaagagcgaaactccatctcaaaaaaaaaaagaaagatgtgtttaagtatcacccttccttaaaactgcaaatatttctagagagaccacaaggctagcagccactcacaatttagtaagctcatttaataatctgacttttttttgcatattaccccagacattcacctgtttagatactgctatacttacatttaagaaaacacttggttaataacatattcccccctcagattcttgaggagtgacatgttcaggcaactcaaagtgctggcaggaataatggcagccaaaggagaatccagaggcctaaaagccagacctcttggggctgagagctgaagtcctgttgctatagataagtgcaaccttgagaaagattccaggacttttgtttctcaggcccatggggcaagcaaacactttctactaggggaagaaaaaaaaaaaaaagaaggttcaaagagcctcaatgtgagttacccttggaagctcaacagattagggaactgttaaaaaaaaaaaaaaaaaaaaagcagaatactagcagccacagaatctagattctattccaaggtctactaataatttgattgtgagatttgggcaaatcaatttttctgagctttgattttcttcaactcaatgcaatgaattgcaataaagggaattggaaaagatgattccttaaggcctcttccagccctataattctaagcttttacaaatgcaagtcttattatttataattaggcatgtaaacttgaaaactccttttctgcaaattttgatggaacatctttgctcatgtaattcatttttatctgttgtcttcacatgaacctttccctctatctgaattctactggctaatttctttgtgaaactttttgtaccaaatcccctttggtttcaatacctagaattataataaaacactttccatttttcaaaaccattatgactggtagagcaccccatcaactggcaaagtcctacttgagtcaattaaaggcaacactgctgagctctgattcttgaagggctctaatgcttggaaatgatttatatatactggattctgaatgacatcaggcttaactgccaagttgcatcaaacaaataatggtactaagttggccatatcgtgagtatctctaaacagtaaatacgtagagcatttagaagagaatctggaacataagtttcagtgagtgttaacttattcttcttccatactgccctattaccgtgctatattcagtacaagccttgcgtagatgaacagcagagtatggaaaccaagattatggtatttttaaaattgtgtgcctaaatattttggaagaaagtgagttttagttcaacaacaaaacccaacccagaacacatgcaaagaccattttaaccaaaatcagggacctctgaaacactgacttgctgcatcctgaaatattgttttagattatacaacagtcagcatcaatgttaaatagtttagccatctggagagcaattaaacaggacataactttctgcatttctggtgactgcgagaatagcagcattgcttacctacacatgcaaataaaaaaaaaatgctcttctcttcagtttgggtcatatgttgaaatacgactctacagcaaagccatacactatccttcaatttccagtgaacctgaagtggcaaccactcctaatgtaagtgtcatgagctggcttctcctgccacctcccttgttttggctgctggggagaatgctgcagcataggacagtaaatggacagtgcatgtctagttgctattctcaagcaaattgttgatcactcccatttcaataaccaccgtctcacccaagttaggaagagatagtatccaggtgtatctgaaccttaacaaaattatagatctgacataattaacctttgtgatgaatttcttaaatggttaatttacaggacaaatttcagcaatctcaggggaatatataattgcttcattctttatcttttggcaagggtaactacaattcaatgattttttacactgaaaaaccaagatgatgaataccctcacaaaggatattgtgatgactatgccctgagctataataaattctcatcataaaaaacagaaattgagaggagtaggggatggtaagacaaaaatactgacccccccccgcaaaaaaatcctcgcattgctatccaaagatgtctgtaacatattcttaaggaaaaaaagctatttacaaaatagaagtagtatgaaaggtattttaaaaacaaaaatgaggtcaatctatgtgtttatatacacaagagaaaaagtctgaaaggagagacaacaaaataataataatgtacaaatgatagattctggatgatttttaatttaaaaaattgttttcttcaatctttctgcttaaatttataattgctaagtttataacagcttacatatataatgcattacactatttccctctttttattgtattgcttttataattaaataaaacaataaacctatttccttggggagggtgttggggggggaagcataccttgtttatagtctcagagagacctcaagttaagctatgttcacaaattgatttatggaatatatcactcaatagtttttggactagaaaaaataggatcagtaagtggcagtaagcattctggatagacaagttgtgcctttctcaataaatgggattcaggagtactgtcagttagcacttgacaggctgaatagactcaacagagtcgtagatgtttgactagtacagcagaccactctaatttgagcaaaggagtgcctatcctaaattaaaatacaagtaaatttttttttttttggagacggagtctcgctctgttacccaggctgaagtgcagtggcacaatctcagctcactgcaacttccatctcccgggttcaagtgattctcctgcctcagtctcccgagcagctgggactacaggtgcccgccaccacacccagctaatttttgtatttttagtagagacaggatttcaccatgttggccagactggtctcggacccctgaccttgtgatctgcctgcctcggcctcccaaagtgctgggattacaggcgtgagccaccgcacccggccacaaggaaatctttagaaaaaatgtaaactataaggtaacatggctcaattaaagctcaagtcagcataatatgattgatgtaataaggtagtatggttgcattttaattcacttgaaaaaggttgctttataacttaatttgcttggtatataaaaactgtgaaggccattacagatttgtaatcttcttgcaaaaatttgtcctcaggtgattttaatgatggatttactacagtgtggaatgaaaaacatgtccatcactctatttggaggtgaataacacggcacccctcagcctttactgctttgagctgctagcaaagaaaacagtcatgtgtgttcatgtgtgtgcatgtacatctgcagtgctgatggcattaactatgcacaactttactgcgctctttcctccacccccaggaacaaacagcaatgcatgaagtagtagcaaaggtaaaacactcttggggaagaatgaattttcatatacatcttgggaggaacaaaagatggatttagtctcttttgaaagagctttggaatttgaagggatattgtcaaaatttctttttgagccacaaaaactcttatcagtgaaaatatcttacagaaaaatactgagagggtgctgaataggccgataaaggtaaccagagcaggtggtgtcactctttacttcataaaaatgaagcacaaactatttgtgagacgcatataaagatggaaagatttatattgccaagataaggtatagagggactaaagagtggcaccctcccatagagaccaataataatgtctaacatttgtaaagcactttatcatttacaattggatttaagcaaaccatctaattccaggtagattcagtccccagtgctcagccagagcttccaggctggcagcctcagtggagaaacgacttctgaagaacacagggcacagcagcagtggccaaatgaggggtgaatctactcacccaccacctgggcacgaactacccagatgagccctactctgcatgctgattaaaataaatgagggctttgataaagccatcgctaaagtctctgaaaggatggctctctccacttcttcctatcaaactaggactgggtttaatgtagacaatgatgaaagggctgttgcaataagcacaccaactcataggagttctggaggaagcttctaactcagttttttgaagggagccttttcagtactgccaaatgtgtaaggctttgcttatttgtgggagggatggcaatctgttctagtgagctggaagttctttctggctaagggggtagcgaagagagagaaatggcactaccaacaggacaggtgcagcaaaaactaagcaaattgataatcttaatttttaatttagaacagctgatacattggttcataaactaactactggtaacatttgtcaaaaaggtttcaggaaaattcagtgaactaaacaaaagtataaaattgcaactgaggctagatgcagtggcttacgcctgtaatctcagcactttgagaggccgaggtgggaggatcacttgagcccaggagttcgagaccagcctgggcaatatagtgagatacccatctcaacaaaaaatgaatgaaagttctatttttaaaatcgcaactgatacaacttgaaagaaataggccacaaattcaggaagatggcttaaatatgaagtttaattttatattggctggtggattcatttcatgaacagtttgatatcctactatgtgcctggtactgtactaatgaaactagtctcgttaggccacagttatacatgagacactaccaaaaagatctaaatcaaaattcctttattcaattaatacatataaaaatgtttgtggtttattttattattttttgagatagagtctcgctctgtcacccaggctggagtgcggtggcttgatcttggcacattgcaacctccacctcccgggtttcagcaattctcctgcctcagcctcctgagtagctgggattacaggcgtgcgccaccacgcctggctaatttttgtattttttttagtagagacggggtttcaccacactggccaggctggtctcgaactcctgatctcatgatccgcccgcctcggcctcccaagtgctgggattacaggcgtgagccactgcacccggccatgtttgtggtttaagtatcactaagggaccatgtctaaacaagtctaataaataacttttacatttactttttttgcagtgtttttaaattatagttgttctttttaaaggatacattgtctagataaataacttcataaagataaaggccatttattggtttttgatcactcagaaggttaatacgtaagttgcaagaccttgggccaaccatgtcacttctttgcccctcagtttgcttatctagataagaggtttctgtgttttatcaacaataagtcctatgattagaaatatttaaatgtgcagctatatacatttttaattcacaattgtgagatacagtaaaaaatagtttttttagctacaataaaagagtaataaaaaaactgattttacttttgaataaaggtgcatggtcttggactactgaagcaatgccaaatagtcatttattgatcactgactcatttatttgtttaaacaacaattaggttcctgaaaaagtagcagacaatttaaagcgcttaagatgaaaattttcagtgaggtgtggtagctcgtgcctgtaatcccaacactttgtgaggccaaggtgggaggatcacttgaggccagaagttttgagactagcctgggcaaaacactgagatcccatctctatgaagcaattttcttttctttttctttctttctttcttttttttttttttttgagacagagtctcactctgtctcccagactggaatgcagtgggacgatctcggctcactgcaacctctgcctcccgggttcaagtgattctcctgcctcagcctcctgagtagctgggattacaggcgtccaccaccatacctggctaatttttgtatttttagtagagatggggtttcaccatgttggtcaggctggtcttgaacacctgacctcgtgatctgcccaccttggcttcccaaagtggtgggattacagacgtgagccactgcgcctggccgaaaaataattttttttaaagataaaaattttcataagaaataaagaaaaaggagacgttttccagcagattttttaaaaagttggttgtgtcaagtattttgcattactataaaaactataataaatagttgctgagaattgaatacttggtcatgaaacaaacaagcaacgtaaaactgattatcatatagcagttagttgctttattttccaccttcccccagtatgggaattgctgaatatgaagtctgttgtactcaggatataccattctcagtatgttctttacctagcgacactgccgcatgttgttctgacagaattctgagagaattatccttgccattttagtgttgggcccatttttattcaatgtggctgatgagctccattttgctttcactgcttcttcatctggagaccctctcagtgatgtaaactgaaagactgttgttggctagcacactgccttctattagtggctttcaatacacattgtgacacagtataaatacatgtgcatatataaaactacatttttttttttttagatggagtctcgctgtgtcacccaggctggagtgtagtggtgtgatctcggctcactccaactgccacctcccaggttcaagcgattctcctgcctcagcctcccgagtagctgggattacaggtgcccattaccatgcccagctaacttttgacttttgtatttttactagagacggggtttcaccatgttggccaggctggtctcgaactcctgactttgtattcccaaagtgctgggaatacagccgtgagctaccacgcctggccaaaattaaattaaaagtttcattatgtaattttctattgcattctattttttttttttttttgagatggagtctctgttgcccaggctgaagtgcagtggtgtgatcttggctcaccccaacctcgacctcccgggttcaaacaattctcctgcctcagcctcccaagtagctgggattacaggcgtctgctaccacgcctggctaattttgcatttttagtagagatggggttttgccatgttgtccaggctggtctcaaactcctagcctcaggtgatccactggcctcagcctcccaaagtgctgggattacaggcgtgagctaccacgccaggtcctatggcttgaacccgggaatcgcttgaacccaggaggcggaggttgcggtgagccgagatcgtgccattgcactccagcttgggcaacaagagtgaaactccatctcaaaaaaaaaaaaaaacaaacaaaaagtattgatagtgattcactaaattgatttcaccactccccaatgaaaaggatgtgatctgtggtttgaaacattattcaatatcatgctgaaaaatgttatgtatagttcataccttgttagtccttgtaattacacacaaggtcttccaaatttttgatgcagtttaaacattgttactctaaaatatatttttagaggtatttatttctttatcactttttaccaaaaacatgtaaatgaagtgaaggtaaacagagaggcaagataaaacagaatcattcttgggtactatggagtatattctattagggtgcatttcaatcttgtaggcttgtatcaataatgctgatgcttagcttcattttttttgtttttgttttctgagacagagtctcactctgtcgcccaggctggagtgcagtggtgccatcttggctcactgtaacctccccgtcccaggttcaagcaattctcctgtttcagcctcccgagtagctggggctacaggtgcatgccaccatgcccggctaattttcgtatttttagtagagacaggttttcaccgtgttgcccaggctggtctcgaactcctgacctcaggtgatccacccacctcggcctcccaaagtgctgggattacaggtgtgagccacggtgccctgcctgatgcttagcttggatcctgttagattcctgaaaacaaattggcttagataacatttggccaaagagctaaaaatttcagtaatttcctaggagtcacagatacatcttgcaaattccagtgctgccatgtcttttgggtaacacagttcactttccagctcaagcagttcctcttcaaattgggccacactaaaaggcaggtgtttgtaattcagagacatcccaaggtttgtactctaaaggcaggcacagaaataaaatcatgattcgtgtgccttaaaatccatgcaatttgactaaagctgtaattgtatttcttccaaataactctgaagctcttcaaaatccacaaatcaatggaattctaaaaataactgatgctactagtactgtgttctaaaaaattaagtaatcttttttttccttccttcaaattatcaggtagaaatttgggggccgggcacagtgactcatgcctgtaattccagcacttgggaggctgaggtaggagaagcctctgagcccaagagtttgagaccagcctgggcaacatagggagatcctgtcccagaaataaataaattaattaattaacaataatagaagaggccaggcgtggtggctcacacctgtaatcagcactttgggagaccgaggcaggtgaatcacttgaggacaggagttggagaccagcctggttaacatggcaaaaccccatctctattaaaaatacaaaaattagctgggtgtggtggtgggcgactgtagtcccagctactcaggaggctgaggcaggagaatctctagaaccttggaagtggaggttggagtgagccaagatcatgccactacactccagcctgggtgacagagcgagactctgtctcacaaataaaataaaatgaaataaaataaatctgggattggccacattgtacccttggatcaaataatggataccctgggccaggcacagtggctcatgcctgtaatcccaacactttgggggctgaggtgggaggatggcttcaggtcaggagtttgagaccagcctgggcaccatagagagactctgtgtctacaaaaacttcaaaaaattaacaaggcatggtgtcttgcgctgtagtcccagctactcaggaggctgaggtggaggattacctgagcctgtgagttcgaggttacagtgagtgacaatagccccactgcactccagcctggggtacagagtgagactctgtctcattaaaataataatacaaataaataataataatggacatacttgggttagaaatactccaatctataaagatatacatacaattggcttttttttttcttcccctgagacaggatctctatcacacaggctggagtgcagtggtgcaatcttggctcactgcagcctccacctgccaggtttagcaattcttgtgccttgacctcccaagtagctgggattacaggtatgccccaccacacccagataatttttgtatttttagtagatacagagttttgctatattggtcagtggtattaaactcctggcctcaagtgatctgcccacctcggcctcccaaagtgctgggattaggggtgtgagccaccactcctgtcccagttgggttttaaactggtatttctcatgcttcatgcaatgcacacacaaaaattttttttgaattaacaatactgttttagtatgtgacttacttgtgtaaatcacaactgtttcaatataaatgtgaattatcactttgctcaatcaatattatcagaaatttacatttgtacattaccttatagcctttaaagtacttgaacaaattaagccatatataaaattttcaacacaaatccgccataaagatgagtttaccaatttggggtactgctttagattgctgaaatatgcacaaaaatctttagctctctgattttatataagatattggcttctctgttactttcctgactttattaacaatttccttgattataatcattttgtttttcttcatgtgtcatgccattttcaggatctggttataagatgcaagtttagactctttcctacaacatctacaacatttggaaccatagaatattggaaccagcaaggatctaagagatggacatgatgctgcctttatttttttagaaaactaaaaaaaaaaaaaaaaagttgcttttgcttataagttgctaatttaaaatgtttcaccgggcacagtggctcacgcctgtaatcccagcactttgggaggccgaggcaggcagatcacctgaggtcaggagttcaagaccagccatagccaacatggcaaaaccccatctctactaaaaatacaaaaattagctggatgtggtggtgggtgcctataatcccagctacttgggaggctgaggcaggagaatcacttgaaccttggaggcggaggttgcagtgagctgagattgtgccactgcactccagcctgggcaacagtgagactccgtctcagaaaaaaaaaaagtttcatgaagcccctatcaatgtttgtattgaaatatgtattccaatatttagaaactaataaccgtttaagataccataaattccaggattgataactgcaaaattgttggcaaaaatgtatcatggttctttgttggtctgtcagttttctactttagtaaagcatgaggattttgcagtcagattgcctggatttagacagcaactctaccatttattagcagtgttaccttgagggaaattacttatcctttccctgtacctcaggagacattaaatgggttaatatagataaagcacttaaaacagtgcctaccgtatagtaagccctcaaaaatataaattgttatttctaaaatatttgatggtaattttaatgattaaattttctacaactataaagtttctaatttcagtgataaaaatggggaattaagatatcagatagactgaaataatagatggatgaatgaatgatctgaatttggaattctgagaggtaaaatgaagagttcaatgttaaatggcttattgggggataaaaagaaacaaaagaaaaaatgaggccaggcgtggtggctcacatcagaaatcccagcattttgggaggccaaggtgggcggatcacctgaggtcaggagttcaagaccagcctggccaacatggtgaaaccccacttctactaaaaatacaaaaaaaaaggaaaaaattagccgggcgtggtggcacatgcttgtaatccccgctacttgggaggctgaggcagaagaatctcttgaacccaggaggcggaggttgcagtgagctgagatcgcaccactgcattccagcctgggcgacagaacaagactctgtctcaaaaaaaaaaaatagaaaaaagaaaaaatgaaagagaaaaaaagccaaggctaggaattcggtccacagacttctactttatggttctttccacttctctttgtagctttacatgtcatctctaggaatgtaaaatacataagtgctatgtagctcaacacattatgaaaatataagtgatccccaagagtgtagctaaaactgttattagtaaacagttactctgatattctaaacagggaaactatcctttaaaaaccaaagacttgatttgcaatatagttttggtgtttccagatttctgcctgactttacaccctgaaaatggtcccagaacaatgacaattaagccataggaatgacaacaaacaatttaatgaaatttccagaatgcttaaaaagaaacttgcttggcacagccatactttccaacaaacccactttaaagttttcacagtttacaatatcagaaatgacctcagggtcaggcatttgtcagttaatgacctgttgggctaatggccttcagctttgccttaggcacataagtcctccagtaggtcattagctgccagaaaagggctcttcccaatcactatggctaaataaataaaatttgctcctgggctaagaccctataaaccaactttggcttagactaagtaaattttttgttgcgtatttacaactttaagaatttaagaaaatgatggaaatgctaaaaccaaaattacattaacatgactgagctatatgtggctatcaatgaggaaagtagtcacatagactcttggatgagcttaaattttcttttgcttatggtattcaaattcagttgaacctcacatcatggttggccatgagaaatagaaatatattgactatggcaatattatatataatacatttagcaaccttgatctttgtaaatcccatttcctaccttccagaagtaaaattaattaaatcagtcttcccccttcatttttttttttttttttttttttgagacggagtctggctctgacgcccaggctggagtgcagtggcgcaatctcggctcactgcaagctccacctcccgtgttcaagccattctcctgcctcagcctcccgagtagctgggactacaggcgcccgccactatgcccggctaatttttgtatttttagtagagatggggtttcaccgtgttagccaggatggtctcgatctcctgaccttgtgatctgcccacctcagacacccaaagtgctgggattacaggcttgagccatcgcgcctggccccccctccattttcatggacatttgctagatctccaaagccagagcgagaaaaaaaatctattttcaagtttgagtgattcagtactcttcttttccctttctaatggtctcacctgaggaactttctgagttaggagtttactaagtactgggtggatagacagctgattcctgccttcgcatctgcagctgcctatctcttctccatctatcctttcttcactccagcaggcttgtatactgtgtctctttctgtcccttcccaaatctcatgttgaattgtaaaccccaatgcaggaggtggggctggtgggatgtgtttggatcatgggggcagatcccttatggcttggtgctgtcttcacaatagtgagtgaggtcttgggagatctggtagtttaaaagtgtgtggcacctccttcccgttgctcctgctttcaccatgtgacgtccctgctcccactttgccttctgccatgattgtaagcttcctaaggccttcctagaagctgagcaggtgcaagcaccatgcttcctgtaaagcctgaagaaccataagccaattaaacctcttttctttacaaaattacccagtctcaggtatttcttttctttcttttttttttttttttttgagatggagtttcactctttcccctaggctggaatgcagtggcgcaatctcagttcactgcaacctccgcttttgggttcaagcaattctcctgcctccgcctcccgagtagctgggattataggtgcccgccaccatgcccggctaattttttgtatttttagtagagatggggttttggcatgttggccaggctggtctcgaactcctgacctcaggtgatcaacctgcctgggcctcccaatgtgctagaattacaagtgtgagccaccgtgcctggcccgtctcaggtatttcttttctttcttttctttttttttttttttttttgagatggagtctggctctgttgcccaggctggagtgcagtggtgcgatcttggctcactccaagctccgcctccctggttcacgccattctcccgcctcagcctcctgagtagctgggactacaggcgcccgccaccacgcccggctaatttttttgcatttttgtagagacggggtttcactgtgttagccaggatggcctcgatctcctgacctcgtgatctgcccgcgcggcctcccaaagtgctgggattacaggtgtgagccactgtgcctggcctgcctcaggtatttctttatcgcaatgcaagaacagcctaacacactgttcacaactcggttaatttcacctcacgtaatctctaaagtgtatatacatcctcttcaatcttcatcctccagttttctattctttctccttttacttattatttcagaaaaattgccactcaccttcttgacttctactttctcctttcaagaagacataaaccaaggatcttcaagttgagaaacatcagaggaaagcaagatttctctcgtgctaagaaaaaggaaaattgggccaggcaaggtggctcacacctgtaatcccagcattttgggaggcttgaggcgggcagatcacgaggtcaggagatcaagaccatcctggctaacacggtgaaaccccacctctattaaaaatacaaaaaattagctgggcatggtggcacgtgcctgtagtcccagctatttgagaggctgaggtaggagaatcacttgaacctgggaggcagaggttgcagtgagccaggatcgtgccactgcacttcagcctgggtgacagaatgagactctgtctcaaaaaaaaaagaaaaaaaaaggaaacttggctgggcacagtggcttacgcctgtcatctcaacacttggggaggccaaggatcatttgagcccaggagttcaacactggcctgggctagatagtccggcctgggcaaggtagtgagaccttgtctctattacaaaaaataaagaaataaaaataattaaaaaaataaaaaaggtaatattagaaatgaaatatgcattaaaaaaccagtgcctaccctcatcctcttattaaaccaaatttccctttatatgtcaacatttaaaaataatttaacaaatatttcttgttcagtttgttttcctattttatttatttgcaggtattgtagaatgcagatttttttttttctttttaaaaagggtgtccttggccaggcgcggtggcttacgcctgtaatctcagcactttgggaggccgaggtgggtaaatcacctgaggtctggagttcaagaccagtcttgccaacatggcgaaaacccatctctattaaaaatacaaaaattagccaggcatggtggcaggcgcctgtaatcccagctactcaggaggctgaggcagaagaatcgcttgagcccagggggcagagtttgcagtgagccgagactgagccactgcactccagcctgggtgacagagcaagactgaaaaaaaaaaaaagggtgtctttgaatgccaggcatatggaagaaacatgtaagctgctcttgctctttttccttgttgttaggtttctggtttgatactcagagaaatgtcaatttcacctgatggcatttaaccttcctgtgccaaaaagctactacattccattgtcttgtggcttcaaaatgggcaaagttccaggttttaatattatttaaaattcgtcttatttctagtataatttgcacacactaatcatttattactttcactttaaagatcaaggaagcatgaccagaaaatggatacagtctctgtttaatatgtgactatattagcaaatcagaaaaaaactgaagaagctaattttgggattctgaaataattttatgatggcattttgacttttctaattaattgatatggagatagtctcttttactgttatactatatgacaccccacttaccaccttctgcatccctttaccctagtcatgcaaatctacacttgagtgggttacatgtataaaaaatattaaccttgggtgtcaaactaaagagcctaaaagatattaaataatttccacaagtaaaatagtgcaagcaaaactataaacactatcataataatgcctattttaaatgcataagacagggaaaaacttaatacatgtttttaggtttcaatttaacatgaatttggaagtaaaattactataacagataagacaaacacaaatagacaatagcatctttattaaactatatagatggtgtaaagggagatttatatgcataaattgagcatatttgtacaaacaaaatacttcattttaaacaacatatttacgcctttaggaaaacaaagttaacataaggaaatacatcagctatgtaaagagtacatctgtgccactggttatccggaagtataaatcactaatgcttaatagaacaacctccaggagtgacatcatgacaatgctcttgggtgtttagacaagatccaggctgactcacagtctcccatctgatatatagcaataggtccattaaatgaaaatgactacaaagaaaaaaaaataacgtgataaattccattctttaaatactaggcttatcattatatatgtaaagtaaaagacttttcaaaaacaagatgacaggtagtaatccacacagtcttatttgcactgtggcttaatcctaaatacaaacccagtctaaataaatacaaagaccagaggaagcctgttaatggccagctagatttcgaaattatagtacttctccacttcatgatttcccttccaattagttagcatgtctcactgatagcttgctgctcaaacactaaaattttagattctggcatgaccacatcactacagcatccagtgatgttctacatggacacaatatagagcaacttatcccaatggaatcaggaaatttatgatttaaaaagaggcattctgaggtcttttagtccaggtctttgtacagtgaagtactaaaataaaaacttgcccttatgttccataattgaaaatgaatgaaaacccaagcattaatttttaaattccctcttgaattcaaaatcttgttaatttgcatttatgtgactacagctataatggtaagaagacaattaccagaggattaataaacaatttctatacttgaagatatttaaaaatctaagtgttacctaaggcaattaccttgaagacccctaatatcttcagggaaaagccaaagggaaaataattgactctgctaattttacccttggcaattataaaacagctctgaatttcatttgactgcagaacccttcatctaatggcctgccccatgagaagtacagagataaacacatcatatagaaattcagacaagaatccagtagcacaagaaaatgagaaattggtagaatgaataagtcataaaaaattaaagttgttacaaatatgccaactttaattaccaatatacatcctcaaagaaaaagcaggctgtcactgtgaaaaaacagtgacatattataaacagaaattctgtattaagttttgcctgtttcctcttgctgtggtatctatttatgttgctattgttgacaaattttctttcttataaaagaaaactaaaacatcattaaatagaatctaactttaccaagacattaagcatatgtagagataagaaaacttggccaggtgcggtggctcacgcctgtaatcctagcaccttgggaggctgaggcaggtggatcacctgaggttaggagttcaagaccaggctgcccaacatggcaaaaacacatctactaaaaatacaaaaattagccagatgtggtggtgggcacctgtaatcccagctacttgagaggctgtggcaggagaatcacttgaacccgagaggcggaggttgcagtgagccaagatcgtgccactgcactccagcctgggcaacaagagcaaaactgtctcaaacaaacaaacaaacaaacaaaacgcaaaaaacttactacactactacttcaaagaaatatttatcgccacctcctccttctaaaaaaaccatagttactattatacttaatcaacttaagcttctgggagctcatttgataaaataagtcctcttctgagatataacttcactttccttaaattattctgatgaaaatattgccaagtatttaaatgaaagaaactggctctgaatatgggagatttgctttatcagagggaattcctgactttcaagaactttagtaattcacaatctcctcagtttaaaatactgttcacctgatttggaaatcatctattacgattaaaagagagctactaaaagccttgatttggagaagatcaattacagaccctgggcatggttcttaaggtctttcacaaaaagtgaacccctgaggcatttttttttttttttctgaaattgacctggtagagccttcaatgaccctttgaagaacaaggtgcaaaagattcacgtttgagattaacaggagggctgcacagaataaagccttcaattcaacatacaactatcaaattcagaaaaaaacatatcatagcctaaaaaggaaaaaattcctcaccagagaaaggttgataaaatgcaaatttaaaggtgtaaacctgtgcagagaccatgaagttatgaggctcactgaaggggaaggaaatgccagatcattcttatttcaagaagcttcaggctgaatagttgcttggatatgctaagtttttctttttctttttctaaatcaagtagtgctactgaaatccagtgcctaatggagcagatggtggaggtcttagactctggaacatttatagtgatgcttctgaatgcaaaacaccaagagtggatttcacaggctgtgaatctgatttgattttgatgggagtaaagcttccattttcactgtacttgaaccacattgaaaaaaagcatgtgtgactgacacaagctagttaagaaaaaggaacatgttaaatattagtcccataaagggaagcagtttaaacaagtgattatttgtttgtatcatttaacatgattatgtttgtatacaataccaccgtttgaaccttatgtaagatttcatcagaatagttcaaagttaaaacaaatgattacagaaaacaaatagaaatttgtccaaaggcaacgagtcttggttttctaaggtggcaactataccgaggcaaattaccaaaatgtggacctaggtactatcaaggtccagaatatctcctcccctcagctttgtaggtctaatccatgaacggccagcctgtgaagctagagctggtcatgtgcagctcaaggtgtccagacactatgtcagatctgcactttctgaggcctctttcttctctaaacaagggctaagttttatcacagaccactgcaaatatggtgaaaaggagagatggatgatacagtttgtgagtcccaggggcaaagaaccactcaccttctgttaacatgtgaattccagtgaaggagagaatttagtgggacccgtcaaagtatactatatgcataaaggagagagacatttgagatgaaataaaatagaattggagagagacatcagattctctttcttttttttttttttttttgagacaggggctctattgcccaggctagagaaacagtggtgcattcatagctcaatgcagtctccaactcctaagctcaagaaatcctaccacctcagcctgctgagtagctaggactaacagcatgcaccaccatgcctgttttttgttttttgttttttttttctgtagagacagggtcttgctatgttgcccaggctggtctccaactcctgggctcaagctatcctcccacctccatctcccaaagtactgggatgataggcatgagccaccatgcctgaccaagattctctaatagtctgcttaataggatcaattcattttttactttagcttttaaaaaaatatgaatataaattagatattaaaggtaccatactactttctcccttaaattccgcaggtctacctcatgagtatatgtgctagccaaaaatgcaaacacatgatgagaaggtagggcagaatgttacttgtctcctagtatcttttatctgtatcttccagatttttggctggatccatgatgacctacaataaaaattacattttctagcttcccttacagctaggtatggctatataattaaattctggtcaacaggatgtaagcagaaaaatctcatataacttatgagaaatgtctttaaagtgtgaatactatataatttatcatgcaaactgggacacaagagtaaaaagaagcgctgaaacaactaaaattttatactttttgaaatatgtatttatttcaaaaacaaacagctgattttattatattgaaataaatatgtatttatttcaaaaacaaacagctgattttattatattggtggactcaacaggttctattcaaaaactgttttcaaaaataaaatttcaaaagaaataaaaataacatacatgtacatacaatagaacaataacttctttatactgattatctgaatatttaaaaataatgagaattattattgatgtatatctacatagtttaatccatttcttagacatatctgtctctaatattgtgtcactggcatttttctgaagaatgtgttcattaaaatacagtatttaaaaataaaactgcccgcaatattcttcacagttgcagtttatggttagtttgaaattactgatactttcaattatggagaaaattctctttctacaggttctaagttacctgataagttcagagtaaatttgctaaatggaggacataattctaattttaaaaatgttgaacagtataaatatttcagcccaaatatttttagaggcactctctttttgcttccatcagagtatcttactttaacaaatagtatttttttttttttccatacggagtttcgctcttgttgcccaggctggagtgcagtggtgcgatctcggctcactgtgacctcagcctcctgggttcaagcgattctcctgcctcagcctcccaagtagctgggattacaggcatgcaccaccatgccctgataatttcagggtttcatcatgttggtcaggctggtctcgaactcccgacctcaggtgatctgcctgcctcaacctcccaaagtgctgggattataagcgtgagccactgcacctggcctaacaaatatttttataagacaaaacttgtcaaataagttgtctctatgattcttttcaatgttttgccaaatttagatggtgcaaaatctaggccttctcaatctcatttcgtgtgtctgtgtgtgtgtgtgtgtgtgtgtgtgtgtgtgtgtgcaatttattcaaagtaggagcaccaccaagattcttcctgcaaggtgagacatttcaaatcgcaactacagaactgaaaattttaatcttgtatatcgtttgagttgttactgtttatatcattccttctttgcttttgtcaggaaaaattctaatggaagttttgttttgttttcattaattgtaattccctaaaagtctcatgtagtgttctgtttattgaatacttgatttaagattctcaagtgatgttgaacgaaatgctgccaattattattagtagtagtagtagtagtattttttgacacagagtttcaccctgtcacccaggctggagtacagtggcgtgatctgggctcactgaactgaaacctccacctcctgggttcaagtgattcttgtgcctcagactcctgagtagctggaatcacaggcatgcaccaccacctctggctaatttttgtattttcagtagagacggggtttcactatgtttgccaggctggtctcagactcctgacctcaagtgatccgcctgccttagcctcccaaagtgctggaaatacaggcgtgagccaccgtgcccaaatgccaccaaacttttgatgacccatttagaataaagttcaataccactgttgggggcacagattgatttataaagatttctaaaatctgatcaacgacagacaacaaagagaaaaggcacatactgctctgctgaagtgtattattattattttttttttgagaccgagattcgctcttgttgcccaggccggagtgcaatggcgtgatcttggctcactgcaacctccaccacccaggttcgagcgattctcgtgcctcagcctcccaagtagctgggattacaggcatgtgccaccacactcggctaatgttctttgcatttttagtagagacgggatttcaccatcttggtcaggctggtctcgaactcctgacctcaggtgattcactcgcctcagcctccgaaagtgctgggattacaggcatgagccaccgtgcctggcctgaagtgtatttttcatctgacatccaccgtgcctggcctgaagtgtattttttatctgacatcagttacaactcccaaatcatatagttcagtgactgtgactattcagatatttgtaaattttgatgtaacaatagcttctattaaaatagaagacttttggtgcttgtttagatgtaatgatcaattgtgtgtgtgccacaaccaatgtcaactactccacaggttgcttaacgtagtaaaaacattgtttttaccacaacactgtgcttcaccaaaatttgtacttctattgttactataaactaataattttattttctatattgaacttttaaactgaatttccaatctcactcacaaaggctttatgtttaatagaatatacttccaaaaactttaccttaatcccatgaatgaatggaaagaaaaaaaccaaaccatttgtagaattaacttaaatgatttacttacttgaaatacctgatgacactgaactaaaactggaattatttaactgctttcaaagttcttctactgacaatgatgcaaaagaactattgcttcccttttcctatatacacataaacacttgtagttgataatcagtgcaatcacttagcatagtcatttctctaaatataagttatgttgcagagtcgtatgcatatataccttctgcaactgcataaagtagatcctgacacttcttcagcagactttactcttcttgttttcatgtggtcaatgatagataccactatggcctccacagtggttggtaaatgtcaacaaacattttgttcaagttattaatatacattccttattaactttcttaagaaaaaaaatcaatacttaaaaaaatgaaacacatacttctagttttttcagtttactgctgccaaaaggatttattgcaaaaacaaagtattgccaagcaataaaatagttatagatttacactgtacaagcaagtgtgctcattctacactctacttgctccctagcagagctgatcagccttgatttcccatatatattttacagacacccaaacctataatttactgtttcccactgaacttatcaactggtatctggcagctttgtgactcttgcaggccatgcatgggctacagtacaattgggtgacacactacacagccagcttctcccaccacctgatacaggaaagagttagctgcccctagacatttgtgtctgagtgcactttactgtattagcaattgccctgcattctgtccttgattgggaagtgttagttgtgtctgaaagggctgggaaaagaggtaagttatttctggtatctttcagatttcctaacaacttaaaatgaagctgggcacagtggctcatgcctgtaatcccagcactttgggaggccaacacaggaggatttcgtgagcccaggagttcaagaccagcctgggcaacatggcgaaaggcaaaagcccgtctctaaaaaaaaatacaaaaaattagccaggtatggctgtatgcacctgtggtcccagctacttgggacactgaggtaggaggattgcttcaaccagggaggttgaggctgcagtgatcacgccactgcactccagcctaggttacagagtaagaccctgtctcaaaaaagaaacattaaaaaaaaagaaacaaaaaaaaaaaaaaggacaactgataatgagaactctctccactgtgtaagggtctcagaatactattacattacattacacaaaaacaaaaacagaggctggaagtactaagtggggatctaccaaattcatcccagcttattctaatataattattagtaataattctctgttaaaaaatgaaaaattcaggataaatgctaaatcagatgggatcccaggatagctggcttacactgagactctcctttagcaaactaggatgtacactgatccaaccttcaaaggaaggagatctgccctttttttgtccttcctcgttctattgactggagggaagccataatggcaaatgcctcgggccatgatgtggtaagataaggatggcaaaacagtaagacagaaggagcctggatccctgactttgcagactcactataccaacttttgactgcctactcctagatgattttacatgagagaaaaaatacattcctatcttatagggcactgttatcttataatcaaacctaatcctaactgatataacaagaaatacctttataacctttccagaaagcagattggcaatatgtatcaagaatactaaaaatgtggccaggcgtggtggctcatgccttaatcccagcactttgggaggttgaggtgggaggatcgtttgaggccaggagttcaagactagcctgggcaacacagtgagactctgtctctataaaaaatttaaaaattagccagccagctactcaggaggctgaggtaagagatcgcttgagcccaggagtttgaggctgcagtaagctatgattatgctactgcactttatttattttttttatttttatttttatttttgagatggagtatcactctgtcgcccaggctggagtgcggtggcacaatctcagctcacttcaacctaccaggctggagtgcagtggcatgatcttggctcactgcaacctctgcctcccgggttcaagcgattctcctgcctcagcttcccaagtagctgggattataggcacgcgccaccacgcccagttaattttttatttttagtagagacggggtttcaccatgttggctagactggtctcgaactcctgacctcaggtgatccacctgcctcggcctcccaaagtgctgggattacaggagtgagccaccacacctggcctttaacctgggtgatacagtgagaccatgtctctataacaaaaggaaaaaaaaaacactaaaaatgtttaaccctttgaaccacttctaggtctttatcttaaagaaataatctggaatagggaaaattgatatgcaaagatctttactgaagatctacttatgatagtaaaaataagaagcaacctaaatgtccaacaatgaggaatctgataaacaagtggtattatatctaagtgactggatattatagaaaaagttataaccatgggaagatgctcgcatcataatattatgtaagaaaaaataggcaggattaaaaaaccttatacatagcaagttctcatatatattacaaaaaattacatatataaaggcattaatgaacaacaaaaaaagactacaaggaaatacatcaagatattaaccagcagtgattatctctggatagtgggattataggtaatatttacttacattttctttgttttgaagatttaaccctatcctataattaataatttcatccataatcagaaaaaaaattactctcaaaactctttcctagcatttacactttgcctggtactaacactgccatcattatgttcatcacagttttactgtttactgagcatgtacatgaggggagttggggcagccgggcacacagacctgcagctccagcagccaactaattgctacctgaagccattcaggtacaacaaaaccctgcccaattttaccttggtgttctgtagcagagctagtccattgcaggcatttgctagaagaaagtctccactcaggatagcaattttatttccaaattgcatgtctttcagtggaccatcagatgattgcaactcatttaaatttactatcccacgatgtacaaggagagcaatatgaattagctccgtgatctctgccaaacttctttgactaaaacataaaggtaagatttgttagaatatcaagaacaccattttatcactaatgtctgatttcagttttcaacaataaaatattccataggttgccccccacttttttttttggattatatctttctaatgaatctttaaatagaggtctctctactgagcagtttgggatctgtaagatgttgacaccttccttctctgtaatactcctcactcttccccacaagtcactaggatatcccagacagaagttgaccagtggagggccaccttccacagctccatttagatactgtgctcttggtatactttcctcacgctcataacttcaaaatttctaagactccttagtagtgtctaatggaattccaatttaagtgagaatataatctgtgccagatactagtctaagggcattacatacattatctctctctcttttttttttttttttttttgtttagatggggtctcactctgtcacccaggtttgagtgcaggggtgcaatctcagcccactgcaacctccacctcccaggctcaaataatcttcccacttcagcctcccgagtagctgggactacaggtgtgcgacaccaagcctggctaacttttgtatttttggtagagatggggttttgccatgttacccaggctggtcttgaactcctgagctcaggtgatctacctgcctcggacacccaaagtgctggaataacaggtgtgagccactgctcctagctacattatctcttttaatcataaatgcaaagctatggggtttacagagatgaatacaatatggtttcttccttcaaggactttttaactttcagaataagaatgaagagagaaacctatagtagcaaataatatagagaaggcccctgaggagcttgtagtatagaactatatttattacacgggaatttcagcagatgtttgttccttttttatacttttctgtagtttgtctattttgtacaatgacaaaagtattacttttatagtcagaaaaaatcaacaggtaattactaaaaatttaaacattatcacaacttcatgataggtattattaacgtcttttaataggtgaaaaaattgtgcacacaagtaaaatgattttcccaagagtacacagtaatgtagacctgaaaatctgttggtatctgctacaaatggccccatgtgagtcatgtcttttggtttccaagctcctgcatgatccccttccatgcctggccatgtgacttgctttggccaataggacatcaacaaacagtacacaaggaaagcctgataagtgcctatgcaactgataagcttttcacagtcacaggcgttgcatgaccccaagcagaagaacactcacgtcaatccacagaatggtaagttgtttcaagtcactaaactatatgggtgatttgctatgtagcaacagatatctgatacagaaatggtatatctataagtggagtgtttgctttgagtcagaaaaatgaggctaggaggcaaaggctgaaggaatggcaaactcttagtggaagctggaaagctactcagctgcaagtataaactgtatcttactgaaaagggaaaataggccaggtgcagtggctcatgcctgtaatctcagaactttgggaggcccaggtggcaggactgcttgaggccaggagttcaacatcagttcaggcaacatagtgagaccctatctctacaaaaaattaaaaaataaaaattagcttggtgagagggtgcacgcctgtagtcccagttacttgggaggctgaggtgggacatcacctgagctcaggagttcaaagttatagtgaactgactgcactattgcactctagcctagcacagagtgagaccctatctcaaaaaaaaggaaagaaaagaaaagaaaagaaaaggaagctcagaaggtagagccaagaacaatggagaagagtggattcgagaaccatttccagggaatagaactgagccctaatcaagaaacattccttgctccaagatacagtaggtggcccagatatatgcccagctggatttcagaattgctacagactagtgactgctatgtacctcccatttctccctctttttaatggaagtgacaactgtggttatcttctttctgattcactgttgcatgttggatagacggtggtgtgtggttggggggagggtggataacttgtccttttagttcctaggtccctgactgaagaggggctgcacccatggagccacatccatatcgagacctaacagaaatcatgagatcagggactctgagcttgatgtcataaaatggatgagactggggtcttgggaggtggtctgttttgcatatggaaggaatgtgaaatattggggccagagggcaaactgtggcagagtgttacaccaagttacacttatcagtcacaccctctgatatccaagccatgtatgatctccttgattgatgctgagtttgaccatatgacttgtttggtcaatgggacatcggcaaatgagggacaaacaggcttgataaatgtttttgcattggggcttacactctttgaatgctaacctgagactacaagttaagaaacctaatctagcctcttagagaatgaaaggcaacatggagaaaggtccagctgtcccagtcaagcccagccccctgcacatttaccaggtaaacacagacacataaataaatacaggagaaaccagcaaaggaacagtccagccaaacaacagaattatgagaaataagttggttattgttttaagccaccaaggtttggagtagtttgttacacaatagataactaacagagactccaatccccaatctatttctactagattaggctgccttccacatgtgcccattgaaagcttctatctttcctttttttctgtagacctcatctgtgtcacaaaagctttaaaaaagtttccttgaagaagctaaatttgagcggggcctggaaaggcaagtaagatttccatagctggagaaaaaggacaaaacaagagtagggcttgggaaccccagaataagaaagactacacatcatgacacagagaaggcaagagtagaaaacgtgaccaaaggttgaaaagatcagtttggctacagtaaagggactgtgtggataagtgagagataagaattttggagcttggttatagcaggtgaaatggtctatattttacacatgcaatattttgagatgaaaggatgatatatattttttaataatttaggaagaagattccaaaggtgatacatagaaaaatcttaaaaagtatgtagggaaagtagggatatggggtgggggagctattacaaaggtccaaggaagatgcaacaaaagggcttgacctaggacaccgccttagacatggagagaaataaatatagaataatcaggccaggcgcggtggctcaggcctgtaatccctgcactatgggaggccaaggcgggtggatcacctgaggtaaggagttcgaaaccaacctggccaacatggtgaaaccccgtctctactaaaaatacaaaaattagccaggcgtgttggcgggtgcctgactaatttttgggagctacttgggaggcagaggcaaggagaatcacttgaacccggaaggcagaggttgcagttagctgagattgcaccactgcactctagcctggatgacagagcaagactctgtctcaaaaataaatgaataaataaaataaataaataaataaataaatataaaatcatcaaataatatatgagactcctcttaaaaaaaacagaatggtttaacatctataataatcacataaagatacaattaaaagaacaaattggcattatcaaatgccaaggaaaatctcatgtctaattgatttcctttgttaaaaaaattaagagaatatgtaaagatgacccagtagacatattgtacttgattacaaatttggggagtagagaaaggaaatgaaccagtgagtcaaatagtatctaagagtaaattcatggtttagattaaaatctcattatatcccaaagaaaatcactaagaatggagacttataagacagttgaaaagttaacagaagacatttttttaaagtagaacatttaaaattaccgtttaaaaagtgactaaaagaaaggaataaaattgtattttattactatcctgcgaatgatttctagtttacaaaaccattcactgaaaaaagtccgcattatcacatttcacaaaaatcacataatgagattatgggcaagtataaaagtaaaaagcgttaagcatttggacaagtttttcatgcagttcagtttatgaaagaaagtaataaccaggtaagcaaaaagttgtggtgttttgaattactcaaaggatgaaaatgagtgattttgacatctatagtcataaaacagcattcattaaataaatagaaacttttaaatgccacatgaccagaaacaacaaaaacaatggtatgcaataataaaagtgaaagcccatcatttttacagggtctgccatttaaaaaaacctttcatttatattatctacttgtgattctaattacagaggtctgcagaggttaaatacttgatcaagaacactgagtttatacaaggcaaagctggaactcagagccaccttgtcatagtaacaaatgacaatttaaaacatctagctgggctcacgcctgtaatcccagcactttgggaggctgaggcaggtggaccacttgaggtcgggagttcaagagcagcctggccaacatggtgaaaccccatctctactaaaaatacaaaaattggctggacatggtggcgcatgtctgtaatcccagctatttggagactgaggcaggagaatcgcttcaacccgggaggcggaggttgcagtgagccgagatcacaccactgcactccagcctgggcaacagagtgaaactctgtctcaaaataaaaataaaaataaaaataaatgtttatttacctaaggaatagtagatcgttggggagggggaataagccaaagttatcaatgttaccatcactgatatatgccacaaatttgtccaatttttatccctagttttgaagcaacagggaagggaatgttgctaggaaaaaagtatattaagaacaggcttaattctttttgtttacagtaactggggaaggtcaagttgtttgaattcaccaggatgaaatcaatagttttagcctaatcaggaatctggataacagttctacttctgcttattacataagacaattcatgggcaaatcccttaaatcagacccgtggtcttcttgtccctgaaaggagggggactggagcaacacatcccttccagtccccaaattataagattcagggatttttttaaaaaaagagttatctaaactggcagttaatagttaaaaagatttaaaaaaatgattactattattggtacctatttttctataggaaataggagtgaaatgactggtcgtctttaaatctatcctgtaatttcactctctagtactgtgctctcagattctaagattttatcaccagataagtaactctggatcatattttgtaagagtacaatttagtatatgtcagagaagcattgacagtatgaaaaaatttgagaaaaatttcttctggtgatcttattcctattttagctacccaaagcaatctattaaactttcaatgcactggatttttaaaaaattatcttaaataaaagtcttcatgccgatttatgtacatatattttagtactcttgaatatttctcatgctaactcttttttttgagatggagtcttgctctgtcacccaggctggagtgcagtaacgtgatctcggctcactgcaacctctgcctcccaggttcaagcaattctcatgcgtcagcctcccgagtagctaggattacaggcatgcgccatgatgtccagctaagttttttgtatttttagtagagacagggtttcaccatgttggccaggctggtcttaaactcctgacctcaactgatccacccacctcggcctcccaaagtgctgggattacaggcctaagccactatgctgggccctcatgctaactcttgattagaaaacagtcacaaataaatacaacttatgttaagtaatcagagtaagaaagtaattaccatattgaaagattaataaatgtttttacaagatttttcaccaaatcactttctttccattatatgttaaaaaatttcatctgcttttgatctgtccattttcctccaaagcttctcaaatttttttagcatcctaagcttcagaaatcagggtggcagacattgctattaatatttgcctatccattcattcctgtgtttgcgccactgcactccagcctgggcaacagagaccctgtctcaacaaacaaacaaacaaacaaacaacccaaattgttacttataataacttgaaatctcttcaaatgttttgcatttaagttgatgttaaaatagcagagttaattgtgttttgccacgcagacaagggagataaaagacaacggagcctgctttctctctatcttctttccttccctttattctttttgagaggttaaaaatatacagaaaagtacatactcttgactacatttggagtggcaatggtcctcacttaaaaaccttacctcctcatgatccccttcagctagatgtgatcatgtgacacagtctggccaatgaaatgtaagcactagtctaccaggtggggtttctgagaaatttactgagttcctgatataagggaacagattcagttggtgtatacctttgatattttgggcttacccatgttccctgactggaatatggcccagctgcctggaggcacagtagagacttaaggatcctaaagagggctcccaaccctctaaacctcctaaagagggttgggggccctcctaaagaggtttaaccctctttaagcctggtagagcaaaaagaattttgagcccctgctgacttgagggctgcatcagctctgatgtgtccacctctagacttcttgttatctgagataaacactgcactctttcaagtcactgtttgttagagtcttgttgtaagtcttgttagagtcttgttatatgcagccaaatacattctgagaagttatagtcaataaaaattgtgacaaaaataatagacatctcatgttcataattctgcactctggttttattcacctaacattatctctcagagacagtcctgtatcatttagaagtagaggatctcctttttctatttaacatcgctactgaggtccactgtatgaaagtaccatacaacttttggggctaaagggtttgtgatcaatattattttttgtctaaagactttttaataatcagaccatgtgtaacttctttaactttcccagagttagaactctttcttctgtgcatgaaagcctttgaatatggctcagtcttgtattgacttgactgtaattatttctttagctatctctctccctgccacccccttccctcacgacactgtaaattatactatcctacttccctaggctgcctataaatatctgttaaatgaacaactctttacttagcaatttatttatttatttatttatttttttgagacagagtcttgctccgtcacccaggctggagtgcagtggtgtgacctcagctcactgaaacctccaccccctgggttcaagcaatttttctgcctcagcctccctagtatttgggattacaggcatgtgccacaatacctggctaatttttgtatttttagtagagatggggtttcgccatgttggccaggctggtctcgaaccgctgacctcaggtgatccacccgccttggcctcctaaagtgctgggattagaggtgtgagccactgcacccagccaccattaatgtataaaggctatagggcatcactatcattcttagtttcaaaagggaaggaatgacataaactaaaaagtagggtttatagaatcagagttggaagtgaccccagaggtcagttagtctctatgtatccccatacagggattagtggtaactacttcacaggagccatgtcagctgatgaacagtttttatttttagaaacagggtctcactctgtagcccaggctggagtacagtggcgtgaccatggctcactgtaacctcaaattcctgggctcaagtgatcctcctgtctcagcctcctgagtggctaggactacaggcacataccaccatacctggctgctttttttttttaattattttttggggccgggctccgtggttcatgcctgtaatcccagcactttgggaggccgaggcgggtggatcacgaagtcaggagattgaggccatcctggctaacagggtgaaaccccgactctactaaaaaaaaatacaaaacatttaccaggcagggtggcaggtgcctgtagtcccagctactcaggaggctgaggcaggagaatggcgtgaacctgggaggcggagcttgcagtgagctgagttcgtgccattgcacttctgcctgggcaacagaacaagactccgtctcaaaaaaaaaaaaaaaaagaagaattttttttttttgtagagacaggggtctccctatgttgcccaggctggtctcgaacttctaagctgaagcaatccttccatctcagcctcccaaagtgctagggaaacagctgtgagccaccgtacccagactgataaacagtttggctgggtgtggtggctcacacttgtaatcccaacactttaggaggccaaggcggggaggattgcttcgcccaggagttcaagaccagcctgggcaacatagggagacctcatctcaatgaaaaatgaaaagaaaaaaattagccaggtatggtggtgtgtgcctgtgattctaagctacttgggaggctgaggcaggagggttgcttgagcccaggaagttgaggctacggtgggctgtgtttgcaacaccgcactccagcctgggcgacagagtgagaccctgtctcttaaaaagaaaaaagaaaaaaagaaaaaaacccaccagaatcgttccttataataacctgaaatctcttcaaatgttctgcatttaagttgatgttaaaataggagaagaattgtctgggcgcggtggctcacgcctgtaattccagtactttgggaggctgaggtgggcagatcactggaggttgggagttcgacaccagcctgaccaacttggagaaaccctgtctctactaaaaatacaaaattagctgggcgtggtgttgcacatctgtgattccagctacttgggaggctgaggcagaagaatcacttgaacccaggaggcagaggttgtggtgagctgagatcgcgccatggcactccagcctgggcaacaagagtgaaactccatctcaaaaaataaataaataaataaataaaaataggacgggtgtggtggctcacgcctgtaatcccagcactttgggaggccaaggcaggcgaatcacctgaggtcaggagtttgagaccagcctgaccaacagggagaaactccatctctactaaaaatacaaaaaaattagccaggcatggtggctcatgcctctgatctcagttactgaggcaggagaatagcttcaatccaggaggtggaggttgccatgagcctagatggtgccattgcactccagcctgggcaacaagagcaaaactctgtttcaaaaataataataataaaataaaaataaataaataaataaaaataaaataggagaagaattgtgtttcgctatacggacaagggagataaaaagacaatggagccttctttctctctcactagcttccttacctctcttctttttgagaggttaaaaaaatacagaaaagtacagagaataatatttacataatcttccacttagaaataataaatatttacactttgtcatttttaacagcttttaaatatgcttttttaaaattttgggaattttcaaacatataaaagtagaaaatattgcatcaagaacatctgtggacccaacatccagctttaaaatttgttaactggctgggcgcggtggctcacacctgtaatcccagcacttcgggaggccaacacaggcggatcacctgaagtcaggagttcgagaccagcctggcaaacatggtgaaaccccgtctctactaaaaatacaaaaattagcctggcgtggtggcaggcgcctgtaatcccagctactcaggaggctgaggcaggagaatcacttgaacccgggaggaggaggttacagtgagccgagatggcgccatcacactccagcctggaggacaagagaaagacttcgtctccaaaaaaaaaaaaaaagagttgttaaccatagttaaccttgttttagctacacccttcattcctctttcagactttgaagtaaatgccagatatgtcacttcatctgaatattcttcgaaaacactattttaaaaagtgcctaatagtgattatggcaactacttactaaattactctgagacaattactgtatgctgaacactatgtaaaaatatttttgcaaaaataactcaattaacaggttaataaacaaaataatatacaactcacaacagctctctgaggtaagctttattatctcttccgtacagaaggcagctaggctgacaggctaagtaacttgcccaagttcacacagctagttaactgcaaagctggattcaagcccaggactctggttctaaagcctgggctctttgcatatcaatagaaaactaataaatatcccaaacacaacatgtgcaaattcagggtctttctaaaaatattaaaatgataggcaagagtcatccatttaaagtcattttacttgaatcctaaaatttgtttttaaaattgaaaaactgatttttatgttcatatgggaagaataaatttgaaaattacaaaaaaacaaaactttggaaaaaaaataagagggctgccgttctagattttaaatcttactataaagttactgcagttttaaaaagtatagtatggctgggcgtggaggctcacatctgtaatctcagaactttgggaggctgaggcaggaggattgcttcagcccaggagtttgcgacaagcctggggaacataataagaccccattttgaagaagaggaagaagaagaagaaggaaaaaaaagtatgatatcacaagaatagactaatagattagtgaaatggaatccagagagagattcaaatgcaaatgaataattatttacgataaaaataacaattcaaatcattagggaaaagatggattattcttacaaatgatattggggcaattggctatcatttatgagaaaaaaatgttagatccctatcttacaccatagataaaaacatatttaaatggattaaccatctaactgtgaaaagcaacactataaatttaggaaaacatccttatggacatggggtgagatagttttgcaaaacagaataggaactcaggaagctacaaagaaaacaaaggatagggggctgggcgcactggctcatgcctgtaatcccagtactttgggaggccaaggcgagtggatcacctgaggtcaggaattcgagactaccctgaccaacatggcaaaaccccgtccctactaaaaatacgaaaattagctgggcttggtggcgggtgcctgtaatcccagctactcaggaggctgaggtgggaaaattgcttgaacccaggaggcagaggttgcagtgagccaagatctaggctggagcctagtcaaggagcaaaacttcgtcgcaaaataaaaaaaaaaaaaaggaaagaaaagaaaacaaaggataaatttgaggagttaaaataaacaaaaaagtttaatactaaaatataccataggctgggcgcagtggctaacgcctgtaatcccagcactttgggaggctgaggtgggtggatcacttgaggtcaggagtttgagaccagcctggccaacatggtgaaaccccacctctactaaaaaaatacagaaatttgctgattgtggtggcgggtgcctgtaatcccagctactcgggaggctgaggctggagaattgcttgaacctgagaggcagaggttgcagtgagctgagattgcaccactgcactccagcctggttgacagagtgagactccatctcaaaaaaataataaaataataaaataaaatataccataaaaataatgaggcaaatacagacttgaagtacttgcaataaatacaataaacaaaagatttatatttaaaatatatgtgaagcttacccaaataagtaagttaaagaaacaatagcaacatgggaaaaggtacaaagaggtaattccagaagaaatacaagtggccaaaaagtatgtaaaatgatgctcaacctcactaataatttagaaaagagtggccaggtgcggtggctcacacctgtaatcccagcactttgagaggccaaggtggatcatgaggtcaaaagatcgagaccatcctggccaacatggtgaaaccccggttctactaaaaatagaaaaaattagctgagcatggtggcacgcgcctgtagtcccagctacccgggaggctgaggcaggaggatggcttgaacccgggaggtggaggttgcagtgagccgagattgtgccactgcactccagcctggtgacagagcaagactccgtctcaaaaaacaaaacaaaacaaaaaaaaggaaagtattacaataacaatgaaataacatttttagttcattgactttgcaaaaatgaaaaagatcaagaagatacagttttggtgaaggtagaaattggggtctcacactgatgccccaagagccaaataaagcccacagacatacaatttggcaaatagcatttccaaaactaaattgaattggaaagcctttggagccaagctcttcagcttgccacagtctccaccacttcctttacctttcacattcgcttgaacagcctgacccttgaaggtagccactcacagggaaatttccctgaatatactactgtattggaccttaagttggtacaatcacttagaaaagtatggtatctaaaaaaattaaaaatatgcatacctcttgacctatgatactctactgaaacagcataattttatatacccacataaacatttttttaattaaaaattttcattttattttttttgagatggagtcttactctatcacccaggctggagtgcagtggtgcaatctcggctcactgcaacctttgcttcctgggttcaagcaattctcctgcctcagcctcccaagtagctgggattacaggcatacaccaccacacctggctaatttttgtatttttagtagagacaggttttcaccatgttgaccagactggtcttgaactcctgacctcaggtgatccaccgaatcagcctcccaaagtgctgggatcacaggcgtgagccactgtgcctggcccaaatttttattgtattttaaaattagagatgggtgaggtggcgtgtgcctatagtcccagctattagggagcctgaggtgggaggatagcttgaacccaggagttcaaggttgcagggagctagcattgcactactgcattccagcctgagcgacagagtgagatcctgtcctctaaagaacaaaaaaacagtgaaataagaataaaaattagagatggggttttcctatgtcagcaggctggtctccaactcctggcctgaagcaatcctcccacctcggtttcccaaagtgctgggattacaggcatgagccacaacatgtccgtccaacatgtttgtttttaatagtgtacattacatagtttggtaacaacaaataattagaaacaagctaaatgtccattaatgtagtacaatactaagtagaaagtaaaaagaatgtggtacggccaaatctacgccttcaaaagttggtaagtgcaaaaaaaatatgagggctggaatatttgtctgttttttccattattctatctccattgtgtagttcagtgcctggtaggccctcaagtctttgttatatgaatgaatgaatgaggagcacaagttgattttcggagaaaaaggaaaaacaatgagaaggaagaaaagaggacaggcagggagcaggaaatgcagatgctgagattatgaactttttaatagacttttttatttttggacgtttaaacagatttagatttggagggaagtaggggatagtcattggacagtagcagacaagcccatctaatacagacaggagcacagatgagattggacttgtgactgaagagggccttgaaaagagcaagcaacgagtttaggtttttctagagcagtatggggtcattaaggaggggctggacaatatgaagatgccgggacgaaattgttttttttttttttttttttttttgagacagagtcttgctttgtcgcccaggctggagtgcagtggtacgatctcggctcactgcaacctccgcctaccggattcaagcgattctctgcctcagcctcccgagtagctgggattacacgtgtccgccaccaagcccagctaattttttgtatttttagtagagacggggtttcaccatgttagccaggctggtctcgaactgctcacctcacctctcaggtgatccgcccacctcggcctcccaaagtgctgggattacaggcgtgagtcaccgcgcctggccgaaattgatattttaagaaatggaggccgggcgtggtggctcacacctgtaataccagcattttgggaggccaagatgggcgtatcacctgaggtcagcagttcgagaccagtctggccaacatggtgaaaccccatctctactaaaaatacaaaaattagaagggcatggtagcaggcacctgcaatcccagctactcaggaggctgaggcaggagaattgcttgaacccgggaggcagaggttgtagtgagccgatatcgtgccactgcactccagcctgggtaacagagcgagactctgtctcaaaaaaaaaaaaaagaaagaaagaaaaagaaatggaggccaggtgcagtggctcatgcctatcatgcctataatccaagcactgtgggaggacaaggtgggtggattgctcgagcccaggaatctgagaccagcctgggcaacacggcgaaactatccctagaaaaaatataaaaattagctggacgtggtggtgtgcccttgtcctagctactcaggaggcttgaggtgggaggatcacttgagcctaggatgtcgaggctgcagtcagccaagatcatgccactgcactccagcctgggagacagaatgaaaccctgtctcaaaaacaaaaagaaatggaatatgccagtataatccaggatgtggagcatggggagagatgactatgactgtcaagaagatcaggctaccacagcataatttcagagaactctagttgtaaagagcccatgaggccaagtagtgcaagctcattagggaaagtcactcaacttctcctgggctcaagcaatcctcccgcctcagcctcctgagtagctgggactataggtgcacaccactaagcctggctaatttttttttaaaaaatgttttttgtagagacagggtttcactttgttgcccagtccaggctcaaactcctggccttaagcctcggcccgtgattacaggtgtgaggcaccatgcctggtcctattttagtatttccagtgacaaggagctgatgacttaatgaggacacctattctgttaaaacagttttgtaagaagtttatttctttacaccacgatttgccaaactgtaactatcacaaagttgtttctacttttctaataatttaggagtgaaatgattagaatgtgaactctaaggtgacaacagaggtacacggggagtgatacaaaataatctcatggaagaactgcagtattgctgtgtgactaaatatggaggataaatgaaagatactttttagatgtgaggctggagtggtaaaacggtagcagaaacgaggcaagcaggaaaatgaaaccaccaggtccgttgctcttctgctcaaaaccctccagtggtccctatctcacttactttggtaaaagccagtccctataatggactccaagtctaatacaatctgccacaatttctccaccccccgcctctctgacttcattccctttgcttttccccctcattcactctcttctgtgacactagcttctttgttattccttaaacatgccaagcctattcttgcctcagggcctttgccctttcctctatctggactgcactcggcttatgtatctacaaggcttagccattcaccctcttgaggtctctgcaaaagtgcacctctctctacataaggccttccctgggcaagccatttacaatagcaaccctgtcatcctcatcagcattctcgatccctacttcctgctttttttcccctccatagctcttattgccatgtgacatactagcttttttccccccacttgtttgtgttttatctctccccaaagtcccaaagaacagggcaaataatcagggtgggagcagacggagaaacagagaaaagcaaaaaaatttctaaaacatgcttcaataatatcaagctcaaaccgttaaaaaaaaaaaaagcatgtgagcgctaatgaaaaggaaaagcatacatacttttgtaaacctgtgccgggtaaaagaatctttcgtgatgataacctttaactaattataagtgccaaatattaattttttataagtagacttaaagtcctaagagtcattcaatttaagttgtgataattagataaacataaggattttcctattttgtcatttattcatgttgataacttaaattaaaatggaactttgtatttggggttggccatgagtatatcattcaaaattcatcttatttcattcttaaattttgaaatgagaattctgattttattttataatttttttttttttttttgagacagggtctcactctatcacccaggctggagtacagtagtgttattgtagttcaatatgacctcaaactcctgggctcaaggaagccttccacttcaacctcctcagtagctgggattacaggtgcgcgccaccatacccagctaatttttagttagttttttttttttttttaagtagagacgggggggtctcactatgttgcccaggctggtcttgaactcctagcctcaagtgatcctcccaccttggccttccagagtgctggaattacaggtatgagtcaccatgcacagcctagaattctgtttttaaaaatagggtaggaaaatgaaaaatctcaaccatgagaggccaagtgccagctgggcacggtggctcatgcctgtaatcccaacactttgggaggccaaggtgggaggactgtttgagcccaggagttttgagaccagcctgggcaacatagagagacctcatttctatttaaaaaagaaaagaaaaaagaaaaatgccaaggctgtaggccgtaataaagatgacctccaagtagtgatcaagttacaggttcaagggttggaaaaaatgaccaggccttacttccagctctgagcacacacactaagcaattgctgagggtactgagagctctgtgtctcttttagaaaagctcacccaccattctaagttatagtatacagaaaagaagcagaaaataaaaagtctctgcagctggtctcagttcaaagagattagatacttcagtctatgttagaatcttgcatgccatgaaaacacaaggtccaaaagtgaagaaaaacaaatataaagacaaaaatcttttaagtagtacttcaattaaaaaaaaaaaaaacctttaaaacaaaaattctcccatattcagtgctgtaatttagaactactggtacttttgcagaaatataattttaaaataatcacagcttaacacaaagacttgcattcatttcctcccctcttgatttatttccaaaaaagaaaactcagtattgatgtgttctgtaattaactccctccatacctgccagccaatctacaaagaagtaagatgcctttggtggtggtagtcatacttgaaagagcagagggatgttgggactcagcaaggagtcaccatatttatcactagaaattagccaaccaaaaagaaatttgtattgcatggtctctttatgcatgaacataataaagctctgcttagtgatcaatgaacacacctatgagagtactttaataaagaataaccaagccaggtgacttactatatttaagaacatttttctaaatgctgttttgaataactgagacatacacttgatactgtcaacacataattatcctgcaggtcaaccagatgcttatgaggaggaggaggggcagctaactaataataatctctggtttctagaaacagttatgtggggctcttatctgccagaggagcagagagaaagcctagctaggcatccttatctaggtttctaaaagtactttggggtttgcatgtcacaaaaggggttaaaaatacttgagactaccaaaaaagcctaacaagacatctgggtgcggcggctgtcactgtcagggcagcccttggagggaatacccgtatcaattcggtttatcagatggacagctgatcaacattaaacagacttgctctgggcagactgagctgagcttcctgacatgaattccaatgaaagccctccgtactctaccactgagctctgccatttttcactgttgcagctccctggacatatgggaatccctagtgatgagcacataaagctgcctctaactcaagtgacggctcatttcccctggctgaaggcagacattaatatcctgaggagatcagacctgcctctctgacccccatctaccgaagcaaaacgactgtcctatttctttctttaataagcttttaatgaagaaaacccagaccccctctctgactgcagcacagttttacatgaaaaggttatacaaatacatcacattctgtgtcaaagttttccaaaatatctgtccccctccccactggagagcagattctatcacttgccctcccatagtgctcatgctttctgccgcggtacgggagttcagttctctgctctgataattacgaattgtatccatggtctggcaggtggaggattaaagaactgattacaaagagcacactggagtttccattttcattacaaacccctttcttcaagggtttgtcatttagctatgaaaactgcttcaggcacaactggactgggagaaatgacagtccactgacaacccagagagtaaactagaaaatgctgctgagcaaaatcagcatatgagaaagctaaaaatatttggtgaactggagtgggcatacatactttgattttagaaggggtagaagaaaagatgtgtgatagcagatgaagaagacaagcaggcttttacctatgaatactggagactggatcaaaataagggggatctcaatcattattaaagtttagtgacaggaccaacgccaactgccaggcattgagttctgaattgcttcacaagaggctgaggtttgggttttctctcctttagagagcaagcaggggttaggaaaaatgtgaaggctgcatgctaaatggggcacagtaagcactgtaggagggaaatgtcattctgcaaagacctctccagctaaataacaagaggcagtgatggaccaaagagggaaccttggcaggcttcacttaggccatcaaatgtgtctgaggctgggaaatgtgaaggtaaggtgggaataaaggggcaaagatctgtttccaatgaaaaagagtgtcagggcatagtctatacagtgagaagcttaaaattagattgcatgctctgctacctaatcaacctaggtatctagagacacaagaacaaatcctaaatgtccccccaaatacttcaccaagtattttcatgtataaaagttgagaaattcctcagaattttttttttaattaaaaaaaattttttttagagacagggtctttctatattgtccaggctggtcttaaactgctggcctcaagtgatcctcctgcctcagcctcgtgagtagctaggactgcaggctcatggcactctgtactaggcttctcctgcatgtttaaaccatagacaataggtgccattggcaggtactaagtgtacagcttaatgcgtaactcataacatactatgtcccagatattctgatttttaaaatatagtatctcatttaatcttcaccaagtatagttattagccctattttacagataagaaaatggaaattcagatatattaactgatttgcccagggccttatgactaataagcaatggggctagatttggactaaaatacttttgctgaggtaaaatataattcatctgctaacaaacctcattgcctccctaaagaaacaatttttttttgtataatggaataattgtgggtagcatttacagtctgtcactagacacaggggttctgttctttttttcttttttttgagatggagtctcgcttggtcacccaggctggagtgaagtggcgtgatcttggctcactgcaacctctgccccactggggttcaagcgattctcctgccccagcctcctgagtagctgggattacaggcgcacgccaccaagcccagctaatttttttgtatttttagtagagatggggttttgccatgttggccaggctggtcttgaactcctgaccttaggtgatccacctgcctcagcctcccaaagtgctgggattacaggcgtgagccaccgcgcccggccagttctgttcttaacatctgttatactgtggactcctttggcaatctggtgaaacctaaggattctactaagaaaaatggttttaaacacataacataaataagattatgaaggatgccaattatgttgaaaataaaaatgtaatcatttttccatccaagttcattgatcgctgaattcaacccacatattcccttgtgggtatctgtgaaaaccaggtaagtactcttgtgaggaaataggaggggatgtggggatgaagtgtcccccgcgttggctaagtgctttatatagactgtttcatgtaatacctccaacaacctgataaagagagaatcattaagattttatatggagataacttagatttagagaggtcaagttatttgcctaatgtcactccaagagtgaccagcacagccagtgtgacctgtgaatccatgctccttccattttaccaaattgccaggtaaatgttgggatgggaagaacatgggggtggggagaaggaaaaagtttgattggcatcacgctacagcaataaatggtcttttattccttgaccttatgaaaagccagaagggagtgaccctagaataattttttttagagaaaaaaaatgacaacaggtacataacagattatatatctttttggtaaatagtctgatgttcaataccaccaccaccatcatcctgtgggaagattatgcatctccatgctcttaaactcaagtaagggtatgtgaattgcttttgtcaatgagaagtgagttaaaaatgtcatttctaagcaaagctgggtcgtggttcacctggtctcttttctgacatgagaccagtaatgttccaaatggagggctgctccatcagccttagtctaggagtaaggatgatatggatatgacacctgaataacaagtggacctttattttgtgagtcattgagacttcagggccatttgcactgcagcataacctagcctaccctaacacatggtgagaatagtcctgagcctttcctttgtctagtatgaaagatcatgtgtactacgtgtatgacagagctggcattacgtactaagggagtaaggcatttatatgatgcctttgaagcatgagtatgaaagatgtcaaaaatgaaatatttatttttctcacagccttatatctctttatttttgtatataatgattgaaaacactggactcaatggggcatggtggctcacgcccgtaatcccagcactttgggaggctgaggtgggtggatcacctgaggtcaggagtttgagaccagcctggccaatatagtgaaacctcgtctctactaaaaatataaaaaattagctgggcgtggtggcaggagcctgtaatcccagctactcaggaggctgaggcaggagaatcacttgaatccaggaggcggaggttgcagtgagccaagattgtgccattgcactccagcctgggcaacaagagtaaaactccatctcaaaaaaataaataaaataaaacaaaataaaaaaataaaacactgaactcaattcatcctttacccaaaatagagtactgcatacttagtaaacattccataaatactttttgcattgttattgaagaatgcctggtttaaaaaaaggttattcaacactatgtttatacctcatcacaaatttgaaactagagaaaaatacgaaaatgaaacatttaatggtgttgtaagagaagtggaaatcccaagaaaaattattttcccctcagtgcttgactgccaccatccacaaagcactgcatagagagtaaacaattacaatggtctagatctgggaagggaattaacagaacatcagatgggcactgcagcaggggcctctcacatgggcatagacaaaggaatacaccccatcctaaccagtggatgacatgggggtagtgacaattaaaagaccagtgtttcccagaaaggcttcccaaatctcagtcagtctcagatttaatgtttatgcctcagtaaatatgaattgctttttcataatcctctattaaaagtgctcttagggtacatatacaatatccctcctttcctagaaaaaatactcccagaagtatctggaaaacatgtaaacagtatttttggaggtgggagtgaatttttttttttttttgagacggagtcttgctcctgccacccaggctggagtgcagtggtgcgatctcggctccctgcaacctccgcctcccaagttcacaccattctcctgcctcagcctcccgagtagctggggttacaggcgtccgtcaccatgcccggctaatttttgtattttagtagagactgggtttcaccatgttggccaggctggtctcgaactcctggcctcatgatccacccgcctcggcctcccaaagtgttgggattacaggcatgagcccctgtgcctggctgggaatgaatttaaggctcatgaaaggatgaaggtgagatgaagattatattggaaacaaaattttatttatttatttatttatttgacagagtctcactctgttgcccaggctggagtgcaatggcgcaatctccgctcactgcaacctccacctcccaggttctagcaactcttgtacctcggacacccgagtagctgggattataggcgtgtgccaccactcccagctaatttttgtatttttagtagagacagggtttcgccatgttggccaggctggtctcgaactcctggcctcaagtgatcctctgccttggcctcccaaagtcctgagattacaggtgtgagccactgccccagccagaaacaaaattttaaaaaacaaatcataaataaaatcagtatgatgtgaaaaagatatgagaaggaaaactgggatagtgcattcagttattattccaaagcacactacaaattatatgaatcccctattgagaagaagtagcagaaagtgagagaaaggtaaggaatgaaaagaaacacacaaacacatatagttggccattggtattggtgggttctacattcctggattcaaccaaccactgacagaaaatacttgtactgaacacgagcagacttttttcctggtcattattccctaaataatctagtataacaactatttacatagcatctacattttactaggtattataagtaatctgaagatgatatgaagcatacaagaggatgcacagtggttatatgcaaatataaccattttatatcagagactataccattttatatcagggacttgagcatccaaggattttggtatccaagtgagatcctgggaccaagatccatgaatattgagggcaactgtatatatacctatatacatagtgtagctttatatacatacatgtgtgcatagatatgcatgtgtatgtatgcatatatgtgtgtgtatatataggcatatgtgtttgtacagatgcatacatacatacatagttggctaggttttagtaaagagtttgaaatccataagacctaaatgttctcatcctaagaggtggcctgatctcccatgggatctgaattgcagtaaaaagaaatgagcactcttccatagcaaatgaagttaacaagaaacatataccaaataggaccaggcatggtggctcacatctgtaatcctagcactttgggaggctgaggcaggcgaatcgcctgagctcaggagtttgagaccagcctgggcaacatagcaaaaccccatttctactaaaaatacaaaaattagctggtgtgatggcacaggccggtagtcccagctattaatacttatggggctgaggtgggaggatcgcctgagcctgggaggttgaagctgcagtgagctgagatcgtatcactacactccagtctgggtgacaaagtgagaccctgtctcaaaaaaaaaaaaaaaaaaaaaaagaaacaaacatataccaaataaagaattaaaagaaaaaaaaccctctcagaacattttttgagatcccaaattcaaattccagttgtgtctttttttaaatacactcacagatgagcattatctcattcaaagcagagagccacagtggtctttgtatccaacccaggcatctcactatctttattttgctagattagcaggatactaaaagttaaaaaatgtttttaaaaatacactggtttccaaaggaacccgaaaatccaggagacaacgctagctattcctgtgaacctctagaggatctgcacctgctcttcaagcaacaaccatgaggaaagtaactagaattgtagatccccatggccctcccttgtcataatttttctctttactgttctcttaccccctttcacactcactgcacctcctccatgctgctgtactaccagtagctccccttaccaagagcttctatgaagaatgcggcttcccgaatatattaatgccccattgtataggagtttttctaaatgaaaccccactttcacccccacatccatatgccccgcaactgctataactctgccactctttgcatgcaagcaaatactcattattggacagggaaaataattactcccagttgtcctgggggcttggagccactgtctgttggaccttacttcacccataccagtatgtctgatgggggtggagttcaagatcaggcaagagaaaaacatgtaaaggaagtaatctcccaattgactcaggtacatagcacccctagcccctacaaaggactagacctctcaaaactacatgaaaccctccatacccatactcacctggtaagcctatttaataccaccctcactgggctccatgaagtctcggcccaaaaccctactaactgttggatgtgcctccccctgcacttcaggcctacatttcaatccctgtatctttaacctccttgttaagtttatctcttccagaatcgaagctgtaaaactacaaatcgttcttcaaatgaagccccagatgcagtccatgactaagatctactgtggacccctggaccagcctgctagttcatgctctgatgttgatgacattgaaggcacccctcctgaggaaatctcaactgcacgacccctactacgccccaattcagcaggaagtagttaagaggtcgtcggccaacctctccaacagcacttgggttttcctgttgagagggggactgagagacaggacaagctggatttcctaggccaactaagaattcctaagcctagctggggaaggagaccgcacccacctctaaacacggggcttgtaactcagctcacacccaacccatcaggtggtaaaaagggctcactaaaataccaattagactaaaaagaggaggtaaagaaatagtcagatcatctattgcctgagagcacagggggagggacaatgatcgggatataaacctaggcatttgagccggatgggtaaccccctttgggtcacttcccgttgtatgggagctctgttttcactctatcaaatcttgcaattgaaaaacaaaaaacaaaaaacactggtttgcagcgtatgtatacacacacacacgtgcataaacacatattcacacatatgtacacatacatacatgtatgtgttttacagcaatttgaggtgggcataggcatatcatttattcattaacccccccaacagaaaactactgacatttactattcacagcagggagtcctataaagactccctgagtcttttaatcatcttttaatcttcccgcaccactttcctatgaaagagaaatttgtagatggcacacttgtttcatttgaaataagcactcatggattttcatccgagtgaacacacattaagtccacattacaattaagtgaagtgatgaaatttgaaagaatgtatgaagatagctttttatagtatataaattgtgattcgcggactttttcattactttgtgtgtatatattactcctttccttgaaaagcagtggcagccttttaaacatttctatagtttttgtggacctaaacaaaaacacacactaaagaagaattgtgaaattaagaattgcccggtgtgtgcagtgtgattttagagtaataaagtttgttttctggtgaataaactatgtatttcccattcaaagtaacttgcttgaaagttatattaatatatggatacctaaagtgctaaaaacactttaccattttttgaaataatttacagttcatttgcaaaaacaaaacaagcattactttcagacacctactgtagctgtcatttatataccttggagaacacatatgttggtgggtatcttatcacagactgtaatattttttcagtaaaagtatgttgacatttttattttatattgttgctatttataattagtttcattaaaaattccaaacacttgaaaaggtaaaatgaaaatttaaaaaaatagtccaggctgggtttggtggctcacacctgtaagcccagcactttttgaggctgaggcaggcagatcacgaggtcaagagtttgagaccagcttgaccaacatggtgaaacctcatctctactaaaattacaaaaattagccaggcatggtctgggctgaagcactgaactcgggaggtggaggttgcagtgagccgagatcacgccactgcactccagcctgggtgacagtgagactctatctcaaaaaaaaaaaaaaaaaaaaaaaaagttcaagtaggtaatgactctatatgggcttaaggtttattttttaggtaataaaaaagttctaaaattagatagtaatgatagttgcacgactctgtaaatatattaaaaattattgacttgtattcttaaaaatgggtgatatgtaaatgatttctcaataaaactgttctttagaaaagttagccttcaatgagactattcacaatttttataggcagatctgaagtctgaaaataatttatcatgcacggtagtaagagtattttgtaggatccgattgtttaaaaagatatttggaaatgccatctcattttaaactttccctctttttttttttttgagacagagtcttacactgttacccaggctggagtggtacagtagtgtgatcatagcctactgcagcctcaaattcctgggctcaaaggatcctcccacctcagcctcctgaatagctgggaccacgggtgcatgccatcatgcctggctaattttttttatagagatgaggtctcactatgttgccgaggctggtttcaaactcctggtgtcaaaccatcctcctgcctcggcctttctaaacgctgagattacaggcataagccacagtgcctgaattaaatctttcctctatttaacattcagattgtatgtctttccctctcttggataatatttcctataaagacttagggagtctttaaaaaacatcacaattatttaatggcctactttaaaaaatatcatataagtcatatgagagtatgctcttcctgtaaaaaaattaaaataatataaaagtatatcaatatgatagccgtcaactgcatgtagctactaagcccttaaaacattgtagctggtctgaattcagatgtgctgtaaaaacttactaccaaaaaaaaaaaaagaatttaaaatatctcaataataagtgctttacactgattacatgttaaaatgatattttagtttaaaaatattacaatcaatttcatttgtttccttttacatttttagtgtggctactagcagattaaaattatatttctgtctaagtccattttctgttactaaattgagtatcacagactgagtaatttataaagaatagttcatggttctggatgctgggaaatccaaggttgaggggttggcatatggtgaggacctttgtgctgtgtcattccatcgcagaagagcaagggagtgagtactaaagagggaaagcacaatgggcttggctccctttacaacatcccactccctcaataatgacaataaaacattcatgagagctccatgattcaatcacctctcatcagcccatctcctaacactgctacactggggaccaagtttcagcatgagttttggaggggacaaacgtgtaatcatagcaatttctttggacagagatacagtgtctcctctgggtccccactaggttcatcatccttccactctacttccttccccagaagttatctcttttatagcttagcatattttctttcagatttttgctatatgtttttaacatatgtttataaacatatagcaaatgctatgcatttacaaccatggaacaaatgctatgcatttttccataaaaatgtgttcatactatacatatggtactacaacttgctttattcacttagtttgaagacttttctatgtcacaaaatatggaaccacctaattctttttaatgatggttatttatttatagtatggatgtaccacaatattctccagaccccactaaaaactatttaggtcatgtcctattctctattattgtaaacactgctgcaccgaacatcttcatacatatatccatgtgcatatgtagggtatttctgtaggacatatctgtacaagtgaaattacaggatcaaagagtatgacatttaaaactgtgttagataactcctaaatgagttattttactttcaaagcaaaaagagaaaccatttgttttttgaccatctataacttctccataagtctctgaaataacaaggacataaacttcatgtccaggattcagaaaagaaaaacaattctaacttatgccctgacatcagcccagacttagccattgactattatggtgggcaccttcttgagggaccctgataatgattcccttttttcttgaaatgcttcctctcccttccccactgagattatacagtgggtagtagctgccatgtctgttctatgtgaccctcagtctccccaaccctggttgagtgacccagagctgagcaacaggcccaatcaaaggcccttagcttctttctccagggaatctgaaattcagggttatctgggagttgccagaggcaatgctccagagctacatttacaaacttcagttatttacttatcactttttgtcatttctgcatattccgcatgtactcttatatacgtaacgcttttctttagattttacctttaagtcctttcttaggatttttatctatgtatagagacaccacatagcatagaacttaaaagagcagattctagagccaggttgcctagattcacatcccagctattccacttaatagctgcgtgagctggatcaatgtgctcagctactctcagtgcccagtcgtttcatctgtaaaatggtggtaacaatagcacatgtgtcaaagtgtcatgggggttaaattactgtatatctagtccttagaacaataacttcaatagtaagtgcttactaaatattacctattactgattttaaaccaactcatctttccatttaaataaatctttagagaaaagttgacataccaactatctggtaagtatcgctcaaaagtgagtcacccacaaagcagcaatacctgaacctgtggtgacagggagtcatccattatacgaccacaggcactcctgtggggaaatcctgggcttggcacagaccacagagtcctctggacttctggatgctcctctcggtggtgggcaatactttcctgctcctccagtcccctctttatcccccagccctgaccagtcattgaaatccctttcataaacctgtgaaaaatcactgatttagactttcagcagagcagaaaggtctactgaataacttaaagtctcataggttttagatattagaactattatccaggtgccccaactcccagacaatgcttctacaatcaataaatttttttcatcagcaaatactttttttttcatattaacaccataccttcttgaaaagaaaattgctaaatatttcaagtaatgtcaatgtttggatcaaggacaactctagaggggtggcaagtgtggcttctgagtcccggtccccctccagcacttggtcattttccacttcaggtatctatggccctcttgctcttaccatgcctcctcacatcagaacctttctctgggaagaaccgtaagtcatttacgctttagggtgagtttaagttcatctaaatgaaaaattttgttataagaaagctctgattttgaatcctggcttcattttctatcacatgtagaatcttacaagttatttcatcctccaaagccttggtttcctcatttccaaatgggattaacaacagttatttcataggactgttgtaaggaggaaattccattcattatgcaagcaacagggattcatgtaatgtcaagtatctactgggcagcagacatggtctattcctaattacaccaattatttagaggtgtggacagataactaatgtcttcttttttttgcttttctggacaagtgggcctaattctccagctttatttattcattcaagaaaaggttaagtacctcttatgtggaaggtaccccagaacattgggaatacagagtagattaaaagttggttccagaaacttacagtctagtgcggaggggccttaacattatatttagaccttcctaagctagatccaaatttaagactcttttcagaatagaagaatattgaggatacccatcatctaacctggtacctcattttacagtcgtagaaatcaatgcctggaaattctaagtactttgttcaatgtcatacagatagttacccaaagaggacaagtaccccaaggccatatgggtgacagaagtacaatccttatctttgaatcttttttctaattcctgatgcccgcccacagaaactgactaaacaacttaagcataagttttctgtttgtaagtgatatggtttggctgtgtccccacccaaattcatcttgaattcccatgtgttgtgggagggacctggtgggaagtaactgaatcatgggggcaggtctttcccgtgctgttctcgtgatagtgaataagtctcatgagatctgatggttttgaaaaatgggagtctctctgcacaaactctctctttgcctgctgccatcaatgtaagatgtgacttgctcctccttgccttctgccatgattgtgaggcttccccagccacgtggaactgtaagtccaatcaaacctctttcctttgtaaattgcccagacttgggtatgtctttatcagcagcatgaaaacggactaatacagtaaattgctcaaaaaaattgtttaatgacaaaataaaaccaggtagtactgaataatcagatccttttatgatgctggaatgcatatgttccagaaattataatttattggtggtccttcagatatagtatgcagatgtattattatacaaggtttttaaaaaattgaactaatatctgacaagcaattttaaaagtcaattaacactgactataaggtacaaaacaaaggttatcagagatgaattttataatcaaattactaagtctgcctttttctgcacaataaacagaaacagtgacatctgaaaatgcccctttcacctcagaaaatgtgttgtttgcaaaagacgttaagtttgcaaatctttgtttcaggtctcaaatagttataagcataaggatctgattttcacagagacctctaagaccacattacttttggttgtaccttcttctctcccacacttatctttctcttttcctgtgtctgcccatgacttctcattctggcattctggatatatccacttttggaaaaggcagataatatggcttattgaagtaggcacacattctgtgaacatgcatttttaacaaataactaataaaatgtactttagaaggatgtccaaatgtgcacatggttctacaacctcatattttctgagcacctgtgatgtgcttggtgatgcctttacaccataaacacaatcacaatccttctcaaggaccttaaagcctggcatggataaaaataataataatcagaaacagagatatctgaaaatgtcccctgttcatctcagagaatacatgaactttttcacaaagggatagaactacgcattcaaatcagcgtacttgattcaaactacttgattgaaactacgcattcaaatcagagtacgcattcaaatcagggtacttgaagctcatctgatatacctccaactcacagatggggcacttctactttttaagccttttttttttttttaaacaggcagttgagagggtggctgtctatattattgtacttattctgaccaaactgtgcaatgtctttatacttttccaagtaacctgaccttttcccatttcttgtgggtattatattacctttcacgtctttatatatttccacatttaatcatcttggcatgttgctaccattattgtcttccctattcactggtctagttaattcctgtgtccacagtagggttcttttttaaaaaggaaaccagcttccttttaccactctgcattcttagactttcttccaatgaagttcaatcacttaaagagtaatataagccaacagtaattattttacaaatactgatgactcctctctttacaaatgagtgtatttgtaagtaagctttgaagatagtaaggctataaggaataagataaatgtgaaatatctgagtagaagccaccaatttccccctttagaggccttcctgatagttgataataccaaatggttcacaaaccaatttagaagtcaaagatgagcacaacgtactaagaaaggagaaagaataatttaacaggcactcaattcagattacatataagcgccattacaacaagctaaaacttgttcaccttaatctatctatatatttcatgactacatgaaatagcctactcctgagttaattaatgaaaaaacaaactttaaaaaactaaatattttgattatttgtaacttaaaagagaacaggtaaaaatggaaagaactgttaacctagattatctgattataattattatcaacaaaattatttatggaatatctactatgtgttagaccctagaaatataaagtataaaaagcatttttcttttatcgacgactatgtatcaaggtgtgagtatgtattctttctcttaaggtagtttaagacatggtctgtgtcctgagggctcatagtttagttggagatacaatacaatgaaatgaaaagatttaacaagaaaattatatagtacataagtgtaaactgaatgccacaatctataactgctgtaggggtacacagttatgatcactgaggatttggggggaggaatgggaagactccaaagaagaggtgacagcaaagttgtacttctcttagatgatgagcactttagattactgaatgcaaggacgttgctgctacacacccaccctactctccatgccatgcatggctgccaccataatgtgctggggggctccagtcagcttgctgctgctgctgctgatcccaacagggctcactgcccctgccagacgatgaacagagtcgacagctgccatggagtggtataaaaatggctgcagccagctgactgaaactggaatatgggtggagcacagatttagcacaaaggcttgggtgtctcctctagacagtgcttgagggaaaaagaaatgagaacaatacagaaaaggagaaaagtccaggaacatccttcatcttctagccacagccccaaatgatttggataaattaaggagaaaaaaataaatgaattgtgaaaaagtcattttcacagagacaaaagaaagttttacttaaattaggctaccaaagaaatatgagttaacagttggtcttagatatcactgaagaatatttactgccagttaattatcagaatgtcaagtcattatacttcctaatttcacctgcacattttcatctgagcacaatgccctgctgtggtctaaaacagaggcctacatattaatcagagtggccgtaacagagttaactcagtttgaagagagcagagaagctaacttagacctctgtcttcattctcattctgaagaaaagaatgaagtcaagatttctaacaagaggtgatacagacaacactctggcaagctgtttcaaaagataaaaatgtacccatttggcttctctttaagtaataatttagatggctcctaattgaactctccttccattgcacaggtcttggcctaccttaagccttctctatgaaaaagactgagccaggagtcctgagggcaaggagtgctggtgaagccctggtgcccacaatgcaggaacggaaggatgctggggtgtgccacaggtggcttatggtaggtggctgtcattgcgaatccttgataacacatgcaattccatttctctgtgtttctacaaagtccttacatgattattctaattatattattaatggcatatcttaagctgttacatggcactacccatagttggatatttatcatgttaaattatgaattacaaacatttcttcatataatattttacttaagtcctaaagcaagaaaatctagaataacgtactatatttgtctgcttggattgccataacaaaataccacaggctgggtggcttaaacagacatttattttctcacagatctggaggctagaagtccaagataaaagtgtcagcaaattcaggctgggtgtggtggttcacacctgtaatcccagcacttcaggaggctgaggcaagtggatcatgaggtcaggagatcgagaccatcctggctaacacggtgaaaccccatctctactgaaaatacaaaaaattagctgggtgtggtggcaggcgcctgtagtctcagctactcgggaggctgaggcaggagaatcacttgaacctgggaggcggagcttacagtgagcagagatcacgctactgcactccagcatgggcgacagagcaagactccatcccaaaaaaaaaaaaaaaaaaaaagagaaagaaatgcaattgtcttaagactccctctccctgagaatctaaaaaaacaaccaggaaagattcactgccaaaaaagagaaaagactaaaagtaatcaccatgcccagagagacttttcatctattcttctgagggcagctctgagagattacctaggacgctttatctgcatattaagacaaccttagttcactgtgaatttctgcccctcactttcccataactggtttgtccttccatcccattcagcgtccaaagagaatcatttacaaaccactgtcttgtctttgagcccattcattcccctaaaaatcatttactaccgctttaaaattgcctacagacctccaactaccttcctttctatgaagagagtatttaagtctcaaccatctggccctgagtctcatatctgcaggactgtcaggtccatgtgctcattaatacatttgtgtgctaaattttccctgttaatctgtctattgtcagtttatctatgcaggcttgaaccttcagaggggaaggagaaactctcttagctcctacacattaaactcagtccattataaaatacatttaaaattcaagtatatttagcaaaaataaacttttttttttttttttgaaatgaagtctcattctgttgcccaggttggagtacagtgttgtgatctcagttcactgcaacctccgcctcctgggttcaagtgattctcctgcctcagcctcctgagtagctgagacaacaggtgcacaccaccacgcccagctaatttttgtatttttagtagagatagggtttcatcatgttggccaggatggtcttgatctcctgactttgtgatccacctgccttgggctcccaaaatgccaccacaaccagcttttttttttttttttttgagacagggtcttgctctgtcactcagggtggagtgcagtggtgcaatcatggctcactgcagccttgatctcccaggcttaagtaatccttaagtaattctcccacctcagcctcccgagtagctgggactacaagtatgtgccatcactcctggttaattttttatttttttgtacagatgggggtttcattatgttgcccaggctagtcttgaactcctgggctcaagtgctcctcctgattcagcctcctaaagtgctgcaattataggcatgagccatgacacccagccttcaatcagcacattttaatattttgtttttttctcctctaaaggacaattttgataggatgtggggtaaaagatgaagatacagtgtagtccttgaagagtctataatctgattatgagaaaaataaaagcagataatatcaataaagtatggtaaatgtagttattgagaatatgaatttgcagtaagaaagacctggttgaaatcttagatctgctactttatggctctgtagatcttggctaaatgatttaacatttctaagcttgactgtccttaccatataaagaggctgtgactattgaccttttaggattgttttgagacataaatgagataacatgtgtaaagtgttttcagcacaatgccttaacacatagtctgtgctcagtacacagtaattattactactatcaccactaatgtttgtacacacttatgcagagtgtgctaagggagcccagaaaagagtacttaggttggcctggggattagggaatgtttcctggagaaaaggagagcagaactgtatcttaagtgaggtaagagtcagatgaagaaaggtaggaacaatatcccatgcagaggaaatagcacagtgcatgcagcgtattgccagtatttggcatttgctggcaggtctagtgcaagaatagttattcctcactttctcccttccttggtatcctacagcactattgcatctcccttcactcccttcactggtttgccatccatcctccccagaaatacccttgctacccctgatggctatgttggatttgtcctttaaggacaattcaatcctttgtaggtggaccaggcctctctagaaccctaccagaacctattctttccctctgtcttatgaacatgaggagagatgacctgcagaggtagtatagctaagctaagagtatgggctctggagttaaacttcctgagttcaaaccctggccccactactatgtcactttgagcaaattacttcacctctgtgtgcttcagttttccccatctgttaaatggggatggtaacagcacttatctcttattatgaggttgttgtgatgattcagtgagctgacacatgtaagaaaactgaaacagggcctggctgttaatagctattagctagcattacctaacaagattaaaaatctatgcttcatggacaggacatacttgagaaaataaagaatgcctcagattagaaatgtggccacctgtggagggtagaaggaagaagggaggataaaagaggaaagagaggaaaactaatatttactgattacctactaggggccaaaagtattgcattaagtgcttcatatatgtttttcacctgatccttacaacagctgtggtaaatagatggtattgtccccaattttatacatgagtatcctggtcctcagagagtttacaaaatttgcctagacaaataggatcagaattgaaagctatgggtaggcgagtagcagagtcatgctcttccaactgctacttctcttcacctccccggggctccattctcttagtttgaaaactatatcagacttcacattgctaagaagaaatctaggagctgcctaattttttaaatgattctctaggcctactccaggaaatataaacatgtgcttacattctaattttatatcctatgctgagaatttaataaaaataatgaattgtagcatataaactaagagtatacttccttgttcagaagttcagaatatattacaattacacattgacaataaaaatattttttagaactccaattctatgttttcagaaattataaattgactaggcttaaatttgttttgttttactttatttatttatttattgagacagagtcttgctctgttgtccaggctggagtgcagtggcatgatctcggctcactgcaacctctgcctcctagattcaagcaattctcctgcctcagcctcctgagtagctgggactacaggcatgagccaccacacccagctaacttttgtatttttagtagagatgggatttcaccgtgtcggccaggctggtctcgaactcctgacctcaagtgatccacctgcctcagcctcccaaagtgccagagattacaggcatgagccaccacgcccggccctacatttgttttataatatgaagcagggcccaatttaatctttaatttacatttcttccagcctaaatattatgtaacatattttgtgggcttttaatatctttaaaatggttcatatttcctagtaatttgagtagggtatcctcttttgtttcgtatgaaataacataatattcttataacaaaatgaaaataaagttaaagaaaaccatgaggtcaggtgtggtggctcatgtttgcaattctagcactttgggaggctgaggctgaaggattcctggaggacaggcgttcaagaccagcctgggcaacatagcaagatcctgttctgcgcatgaaggtagcacttgtagtcccagctactagggaggctggggtaggaggatctaagagtccaaggttgcagtgaactatgattgctccactgttctctagcctgggtgacagagagagatcctgtctctaaaaacaaaagaaaataaaataatactatagtattatggatgttatatatgtagaacgagctttttcatattgtcaattctttgccaatggagatgattcacacacacacacacacatcttgtcacatgttggcccttatactgataaaacagcaccaatccttcagggaagctccaaatactctatgacaagaagctgggggtggtggcagtaaggaagcagataatcttctatagagacattttatatacatatatacttatttaacctaaaaatatatttttttctttaattacagtttcccatataaccatcagtgggctccagcgatgcaagccatatttattagaggcagcatgtcaaataggagttgacaattacagtctctatcaatacatattatgccagacggtaatgagccatccacaaagggctagctatccaaaataatcatgctgctttccagagaaatgtcaaagaggttatggtttattacacagtgctcattagatatacagtggcagcattagcaatttttccttcatttgcgtctcatttaaggatctgcccccacaagcacagtcaaattagtacgcaaggttaaaaccattatgccctgaaaaaattaagttgcattttattttacagtaacggtggatcaaaggtccttggaatctattatttacagaaccattatctaacacagcatattaacaaaagggaaaagaaaagcaatgccctgccagcatggcttggacaggaacaaaggcagactgtttgaaataagcaaataccatgttacttaattaagtagccctataaaaactatttttaaaataacactaaggttgtgacatcaactgacaaaagtcacaaaattaaagttaatgaagtaccaacctgtactttaaaatgtcttgtttacattaacttatttttaaacattttaatactgtcattatatataatttttaaataaatttaccaattactctaaatacttattttcttaaaaggataacccatttttaaatttttatagcaaacccacatttatcaatatttaataaaatagaatttgcagatataactattataaccagaaagatgtgatcaagaaggcagatcttggaataagttacaaagatttaaataaatattgcaaaataatagatacttaatggattttgccaaatcagcagataactggttaacagcatctgaattactggcaggataaacatttgtagcaaagagatcttttgaagagatttctaaagtcctgattggactgttaataaaatatcaaaattcattacagttagaaggataatattctgaatgtactttccccacattttattaacagacctcagttgtagtgattattcaaggatcctttcctttcatttaatgaacacttattgagtgctgtcatgtcagaccctgtgataagagtctgagaattcattaaaaagaaaaaagaaagaaagaaagaaagcatatctctgtacttgagaagctcatggccaggtcagtgaagcatttggacaggaaaccaaatgatttgaatcttgggcaataattgctgtcccagaagaaaatacagcttgccaagggagcccagatgaagaggacctaattgaaatcttgatgaagtaaggtaaggattacccagggaagtaacagctaaagtgagaattctacccagtgagaactgtaggggagaaatacactgggaaggtgggcgaacaagtgagaggaggctggggcgggatcatttacctcagattatcacaatatacagttttagaaatcctttaaaaatgctcttcctaattagaagaaaacatcttgaagttggattgatggacttaatgaaataaagtcagcaagaaagttctagaacagtttggatcatgttaaaaaaataaaaagtatgttatagaaaaaattcctttgtcaggtccacatatggtcaaatttcagagtggatgaatgtattatccatttaatgttaactgtaagtctgatttaataacttgtcatgaccaaattttgaatttctgttggttattcttcttaatctttacccccacatgaatgaggtaagcatccttgtatctttccccttaaactgacaaaaggatgagctatatatacatcactttaatttttctggtatcttatatgtctagtatgtgtgtctactctcaaaacatctgtaaaatataataaacttttagacagcagaggacggattggtttaattcttttgctatggtatccagtatagctcaggtgtaatcagatacttacaaaaggttgcttttttttttaaatgtaaatgccattatattctagtacagctattatatatggctatggtctacaatatggcagattcctgaatggattgttaggtggttttgaggcatttagagtagcatcatgacagcatgatagtaatactcattttcctcttttagtataacagatttctttttttcgtgaatattgggcctttttaaacaggccctatatatctactctgatttagctttttaagtgactgccgttctcccttcctcaacagtgttttaattcagcagtatttaacctaccaacatttttcatttaatgaacaaaaaatgtatagactccaaagcttttttaaaaaacaaaacatatactacatctatagctttgcacatattgtgcacataaaactttgtataaatggttgcagtattattcctggctttgaattttgcttttcttctaccagaaaaagcttctggtaaccagacgtcacaaaaggtacagataatcataagatgtcaatcataatacaaaaacaagttatattgttgaactgcagaaaaagtaaaagcaactaggccccatgctggtcactactgctctacgttcatttcaatactacatgtaattatgaatctcaaggaacaaaccaagaacgagcctgctgagagtggagacagaggagtatggccaacctctcctccacggcacctcgcagcagtgtcagagcagccattttgtcagtgcgtctctttctttccactgctctaagatcttcagtttattcatttgctctcacctctgccctattccagagggtttaaatggtttaggtattattagatgatgttcagtaataacagaaaaaaagcacaaccagatgtggaggaaacatgagacaaaggtgtgacaagagatgaagtgtgataaactgagagggcacaaaatgggagggggccagggagagccccagagtgatgagggaatagtatgaactacagactttaatgtagctcccagaaataaaggcttcttctgtatgtgatgagcctattttatctcaaaatgtaaagctgtctgaattttaggtttgatgaccatgtgttctgcaaagacagcatatagattacaaccgtgcctgacctcccagttttaggaacaaagtggaattctgtcactggacaccatcagggctttgggttacatctccaactccttattctatggataaaaataaaagctcccaatataatattcataatttataacaataacatgcagatcaccttttaccgtttgaaaatggcaccaaattagtaatggtcaccatttctacagcaaaaaataatgtgagcactttactgcttgatggtactgttagattagtggtccccagtttggggtacgcagatctttaagggttatttacagtaggtaacaagttcttcacagaggtgagtaattttccctttccaaaatgtcgaaggaaagcaatgtattccccctccccccagataaagtaacatctgttaacaaaatttttaattttctttaattttgtactcattaataagatgcgacagtggttatcttgtggtcatcagaagctcagattggcagttacaagtgtatctaataaaatggaaaatcatataatgatgattttatatataaagtgcctggtaaagacgcttttttaaacaggggtgggagaataacaaaaggaatcctgagcggtaaacaggtggggaggttatcataatgaagtatatactggctaatttccctccacttctccttgaccgccccgcttctttcaccaaggcagtctaagaggaagtagctatctacttcaacaacagctctaacaggagaccagaagaggtcagcggagagcagtgctaggcacccatcctcccacccagagggctgagctccagaagatcccaggtctctgtttactcaaaaaagaagcaactatgaaaacagaacaaattgttttattcaattttttactttgacacaatcagagatgacctataagtctgttgtaatggttagcttaaaaaaaaaagatctgaagtagaaaatgaaaaaattttccttatataccaaaaagttccctgaagaagacaataaaaatgataatgccttgatagtgacataatcttattttctctgagatagctagcaatccattatttcttaaaaacatgagttgcaggtgcacaaaaattcccatttaaatatactcagttcatcggccgggcacggtggctcacgcctgtaattctcagcactttgggaggccaaggtgggtggattgcctgagctcaggagttcaaaaccagcctaggcaacatggtgaaaccccatctctactaaaaacacaaaaaattagctgggcctggtggcaggcgcctgtaatcccagctacttgggaggctgaggcaggagaatcacttgaacccaggagacagaggttgcagtgagccgagattgtgccattgcactccagcctgggtgacagagtgagactatgttaaaaaagaaaatatatatatatacacacacacacacacacatacacacacacacacactacacacacactcagtatctgattatttgtgctatggaaaaaagaatgtgcaattactaagaactggtcaagtactacagagtccctggtttctaaattaattctaaaatcggaaagtggaaaaattaaacatgttttttgaatgttttaaatatttaaatataaatgtttcttctcttataccttcagggagtgtaaaccaaatagaaagtttcccctactccccacatttaaagctgaagaattagaaggaaaacacactatataaacttttaaacaccagctgtagtgtttttacttgccttcctcagaacttccttcattgaaggtacagtacctaaaaaccagcttttgctacgttcccacgcaaatagaggtcatgatctggggtgttctgattgactataaacttgtagtagtataccaggcacagaaagaatggcaaccacaaaagacaacgtggtacctgacgttaggggccttatgaatttaataagggcattgataaaattagaaaatgctaaggaaagacctaaaatggatgaatatattcaacagataacagagaggtccaagttaccttgcctacccctctaattgtttttgaggaagatcaactttcagccaaagcgctgcagacaatataaaacaaagtttgcataaagtacctttgaaaataacaagctgcctataaaccgttgcagacgtgtcagtaacaaaggttttgcaaagttaaagccctaaattgaattaaaccctaataattttgtattattacattttcattccctgacaattctgatttttcagcttactgtttttgttaaatttaaattggtctggtctatctatagagagagataaaaaagcaaatccctattttttaaagttctgagttgaatggtataaaattaaatacagaaatgcattttaagtgcaaagtatccttccactgttgccagaaaacaagtaacaaagaggagttaagtaatttaacagccatattttctcactcgccttcattgggaacacagtcgtttgcatggcataataagctgtaaattataaacatttttacatagcctgctgcaaagaaaagtctgccagctttctactatattggatagtgttcaagtgattaactatagctttggaaaaaaggggtggaaacttgttttgcgtcgcagtttgttggttctcacgtacagcctcaaaaaaatccattacatcattatttgcaacaaatatgtaagtaattataatagagtaatagaagctccatattattacaggatacaaattactcatggacaagagaaaatcttgtaggtgcataatcattcaagtatttccttgaaatgttgtctctaatgagtatgaatgtaatggtttccaaaaataacaaaatttgcagcactgacatttcaggactaatgacaaatgaaatacactttactctttgtctatagggaaagcccattagacagaatatctgcttagggcacaagtctattttaaaaaaaggttcttgtgtcaaagaaaatatataaatatctgtgtttcacaacatataaagaataaatgtgtgaaaggaaacatgcagtaatagagataatggcctgcaaacataaacgtttttatttttaaattatatagagccccaccaaaatccacattcaaccccctaagaaaattttgtctcaataaatcaacaataatacatggagcacttgagtgcccaccatagtgctggggctttggaggtcaaagaaaaagtttataacctgatgtctgtccactatactgaggatgtcaagatgactaagaaagtatatgtaaggcaccctacttcataggttgtctacagtaatggaaagagcatgaattctatggtcaaatgggatttgaaactcaactctgtgattttcttacactataaacttgagcacgttattaaatttctttaagcctgtttaccaagaaaagcaatttcttaaccaatgttaaatgttaaataaatgcactaatatatataaagaatatggaacagtagcagacttatagaaaactctatatgtgttagctatagtaataattatatttctatatttattatagttagctttgcacacagcaggtgttcaataaatgtttgttgaatgaatgaatgaatgagcaaaggaacaaatctagcagagggacaagataaatatgcagattactataaaatagacgagaagtgcctcaaaggtacaaaatgtaatagaggcctcagtggagggagaggtgataggttggaagatgattaagacacaaaccctgacttctagaaggtactgtttagtaagaaaacatacataaatcagtatttacaaaacagtcattacaaacaatgtgttaagtgttttaagatttcacagaacctttcttctatgttctagctctaaatacaccacggcttttcccggagtgtccaaatcctatatgttcatgagcagatatgcctaacttctacaagccacaaactgaggagctgagaggtgggaccagtgctcagtgctccccttatttcctcattttggtgaaaaccactgttcctttgaaaccagctctacttctgccatcactcctcttctctgtgcctctacatttattgaagtctcagttctgttgttctggttgacttcaatcatgtgaattgcccaccctacagtttttcaatatactcaattcaaccacctccactgtattctgtgaaacccactttaaggcacaactgaacataaccaatcagaactgttccacttttgaaatctccacttggatatccaactttccatctaaaacctactgtcttttctgctctttcattgcattaccacttccacccctgcaaactgattcatcatgatctccagtcccttgatcactactttctctctagttttgggctccctcaacctcacttcctacctgatggggcctaaacaatcatattagatcaacctacactcttgcacatacccttttcttgatgacaaagaaaaacattaatcatgcttttatcttcctcacatccactctagggctgttaggaattgcctgttgctgtgttaaggaatttgtatctaatcctgtagggaatgcaattgaagagttaaggatgttttactccacttaaaaacttgaggccaggccaggtgtggtggctcatgtatgtaatcccagcactttgggaggccaaggcaggtggatcacttgaggccaggagtttgagcccagcctgaccaacagtgaaatcccgtttccactaaaaatacaaaaaaatagccgggcatgaaggcgcacacctgtaatcccagttacttgagaggctgaggcatgagaatcacttgagcctgggaggtggaggttgcagtgagctgtgatcgggccactgtactccagcctgggtgacagagtgagactatctcaaaagaaaaagcaaacaaacaaaacaacaacaacaaaaaaacttgaggccgggtgtggtggctcatgcctgtaatcccagcactttggagagccaggtgggtggctcacttgagcccaggagtctgagacaggcctgggcaccatggcaaaaacacctctctacaaaaaatacaaaaacattagccaggcatggtacatgcacctgtagtctcagctactcatttgagcccgggacattgaggctgcagtgagccattatcgttccactgcactccagcctgggcaacagagggagaccctgtctcaaaaaacaaaaaacaaaaaccttgagaagaggagggaatgagggaaatcttaacaacagaaaagggagacttaagattccagtaactatagagagggaggatgccaggattagagataaccaatcagagaatctgccctctttgcctctattatcaacaccacccactttcaggagtgagaaggaaagtccaagagcacagtgaggaagacatttcttaggcactaagccacctacagatgtcagctctcacctatcatcttatgtgaggggtgttaaagactacctacctttagttaaacaaagggtttatcagtggacatgggtggattgtgaacccaatggtgactgtggaaatagctctagtagttaagttccagcaaaagagttttagaaaggaaattacatcaatagcaagtgtcaggaagactctagatgcatacattgtttccttacctactcatttgaggtcaaagactatttcttattcataagaaatattcagtgtctttcagtgtccagtgctgtgccttgcagagacaggaggtggtcagggtgacttattctggaccacaggatagttgaacctatctagatgtgtaccctgttagttaagctcctggtttgaagcccatcattgcccctgctgtacagatgagtaatttcaaagagtgattaagtaacttacttaaggtcaaatagctaatcaattgcagaattgagacaagaacccagatctctggcccttcatctatgcctttattatgacacactgtttaccactgagatgccttccgtatgagttcaaaggatcaccattaagtcatgaagctactaagctgactctgccaataaaattaatattttaagtgatttgcacaacttctatcacatgatgaatgcccaaaattaagcactgtttaaaatgtagaattagtcactggacagtgcctttaactttggctacttaccagtcaacatacagcccttctttaaggaaaggattttaaaattttttactattaacaaaaacaatttatgcagcttgtgttttgctgtgatagattaggcaggctaatctatatcatgttatttacatgcaataaactaactcagctgagtagattagtaggtaagcccacctactttttgtggttaattatactgttttgtaagaagctgatcctattttgtgtttttccaaaagctctggtgaagtaatgacttctgacgtacagtatgttaaacataaagagccttcccttttctttctcaacatataattgctgcatttgtgcatgctgtgcaagttgaacataacaataaaaacttaatgaagaaaataagtactggttgtaatgaattagtaatattactagatttgtatctggagtttacatttactgttgtaagtagaatacaatcaataggaatatgtaatcaaattgcacatgctttcatctcttgagatttatctgaaaaggagctgagatatctttaggaaattatttccaaaagcctacactaaattcaattattctgcataatcatttaaaatcactgtcaataagcgctcctcatttttaaggttcttgtagtacaaaaagatacgtttcttaaataggcttttattgctttacaagtatgaaatataactttttcatttttaaatttagttatacaaaataacatgaataggttattaaaaaactgaaatactacaaataaagtcacctttagaccattcccttatatctgtttccaaacctctccaaccccttctttcttcaaccactgttattagcaggtgagtaaggttccttccagactctttgtttgcattcacatgttatcttaaaaacaaaacaaaaccataactgatttttaaaatgctacatatttgaatattacctatttcatgtttatataattgaccctaaataaataacatgatcaacatgttctgccttaagcctcatttcttaagatgttttttgatttgatcagtccccaagggaaatacagtttgttaattttgtttggcattttgaagtgctagacgaattctaatgtgtggaatgaaggtgaggatggatagatagtcacagcctattgttactataattagaagtcgtcagatgctaattagtaccacattaaaatgataaattatgaactacaatatttgcagctgagaccaagtgcaattccctaaatgtaaaggtttatagaaaaaaaaacggcctctttcacagctttttatattctcccttctctccttaagattatttcacacaggcctccaaatattctatcacttcctctaacaccacactaagcgtaaccaattttcacttagaggagaaagtaatgttaagatctgtaatttgattttaagatgtttctagatttaacttatagttatgtttatgatgatttttgtgataagttcttgaagcccaacaattacctcagtatgtacaggtgtttcttgacttacaatggggttatgtcctgataaatccatttaaaagtcagaaaattttaagttgcatcatggtaagccagggactacctgcatatcattaatttaaccttaatcaattgaatacaccgagtagagtgaagaattagcacaaatgcgaagaaattgatggtgtccatttgaacagatggcaaattttaaaaagctaatctaaagatagcattttacttcattcctgctttttttaacaaaaataattttttttatactttattatttttatttgtagtttatgcattttcacaggatatttgatctggtcaaagaggccaaaggataaaagttcaggtcagcccagggactccaaagccctcattctaattacaggatagggtttctaagctaactacctgttcatgtcttttgtccatgtttgtgttgtaattttcttcttcccgatttataagattttcaattgatttgtaggttacaacttggcttttggtcatgtatgttgtaaacatttttgtaatttgggctttgtcttttgacttcatgggaattttttccactgaagagttattttttgtgcaaatgtgttaatcttttcatttatagtgtcaagttttggaactttttcataaagtcctccctgctctgagataaatactaccactactagtgacaattattcagccatgatcaaatagtcattgctatctatatgctagaaacatgctgaatgctgaggtaatacggataaaatacaattatctgaactatgttttttcttttttcttttttttttttttttgagacagagtcttgctctgttgcccaggctggagtgcagtggcacaatcttggctcactgcaacctccgtctcccgggttgaagtgattttcctgcctcagcctcccgagtagctgggacttacaggcaggtaccaccatgcctggctaatttttttttcttgtattttagtagagacgggattttgccatgttggccaggctggtctcaaactcctgacctcaagtgatctgcccatcttggcctcccaaagtattgggattacaggcgtaagccactgcacccagtccaatcatctgaactatgtttaaaagcacatagaggacacagtcttctcttatcagcattacaaataaatacagaaaatgttcggtcatgattttcttcttattcgccaactcacctgccacccagaagtcacataggtaataagataaaaatagttgttttggctgggcgcagtggctccgcctgtaatcccagcactttgggaggccaaggagggcagatcacttgaggctaggagttcaataccaccctggccaacacggtgaaaccctgtctctactaaaaatagaaaaattagccaggcgtggtggtgcagacctgtaatctcagctacctgggaggctgaggcaggagaatcatctgaacctgggtggtggaggttgcagtgagccgagatcatgccattgcactacattctgggtgacagagcagggctctgtctcaaaaaaaaaaaaaagtagttgttttacagatagaattggtatgctttaaaattggtcagtatccattatgtatcctggcaaatagaccatctaaaaagaagaaatgccaacgatgactttacttctcattcaattactcatttaatgttttttcattcttgcatattctacttgtacctgaattgatctctatagcaaacagattagagacagagcaaggtgggtaaaaagaaggtggctacacttctataaatgaatatgtgtgtcccaggacactgcagatctttaattcaattcagtgtttttttcctcagattggcaggtgtgtctcgcagttggatgtggtccagcaggtccctatgctgcaattctgaagcagtgggaacatcatcattgcactgggtccccagcagcagcatattctctacccactgctgcttagaggaaatggagttaagggtaacacaaactcaggagagtctaaaacctatcagtaaaacttcaagacttatagataccagaattgaagctgcagataacagaggtgggcaaagaaagtgtagtagaaaaaggaattggttgaaatatgaaggaaaaataaaataaacttttgatgagacttaaaaaatttccctggacagggccaggcaggctggggtgcagtggcacgaacctggctcactgcaacctccacctcccaggttcaagcaattctctgcctcagtctcctgaatagcagggattacaggcgcccaccatcatgcccagctaatttttttgtatttttagtagagacagggtttcaccgccttggccaggctggtcttgaactcctgaccttgtgatccacctgcctcggcctcccaaagtgctgggattacaggcatgagccatggtgcccggtcaacacttttcttttccttctttaaatatattatattgcttcacataataactagcttaaaaattaagattgtttcatgaagaatgctttagaatctggttatagctcacatcctgaactacaggttgcaaaggacataataaactgccatccctttaagtcatcgtccatgttaaactactctgtaagacttacactgtaaaacatgtgtttcaaatgtttgcgtcagtctaaaacacttatgttatacagaagatccagtcatccagatagagatttaaatgaatactatgtccaaggcattggtgagttgtaaaggtatacaaagctaagtgcctactctgaaggagtgggaaatctaataaagaccatgaagcagcatgactggggtctggaatggcaataataaaccacatttggaagcatattctatgtatgaggcactgttctaagggttctcgatgtattaacttatttaatccacttaatagacatgaggcacagagaggttatctaacttgtctggggtcacacagctagtaagtgatgaaacaaggatttgaacccagacaatttataaccaatatacatatttcttcctctacttgactacttaatgtgggacctcggaaagttacttcacctgagtctcagttttctcattggtgaaactgttttcttttcttttcttttttattttagtagagatggggtttcaccacgttggccaggctggtctcgaactcctgacctcaaatgatccacccacctcagcctcccaaagtgctgggtttacaggtgtgagccaccgtgcccagcctgaaactgttatttctgcctcacagagttctcattaggattcaaagttaggcatgctgatacagagaaacatttaccaaacttttgccgctttccacaaggtgtactactactgacagggaccaatgggttctgtagtcaaatgactgggaaacaatatctcagagtcatgatacataaatccgtacctaactcctaagaattctcaaatgaaggaatctctctaactctgtttaacctggcatgcccacacttatttgatcccagaaccttttgtcccactgaacacctagttacaacttaagctctggaagaaaaattggtaaatgctaacaagaaaaaggcatgaaatcaaaggacccagtgggttcaggtctggctcagccaatttttaactgcttgctatgggcaacagctccaacccctctccatgtctctgctttccctctcagcttttgcctagacgacttcactaattccctggctgactctctatcttggacctcacctctcagggtcaccttctaagcgtcagctaattatgttccatagcacagatacagtaacatgaccccttttgcttaaacacctttttgataatagctaagaataagagcaaacacttacagaatgcttactatgccatgcagtattctactcactcgtttaattctgaaaaccattctgtgaagtacatactgaggtgcggctagcaggtggtgcagtcagcttccagattccaagtccactctgctgcctcttgaactccccacaatttatccaggatatcgccctaattcctcaggcccttcacagtgtgacttcaacctttcctttccacctcatcttcattccctgcttctcatatatgagtttctagggctgtgaggctggcctgtagatggctgccttcagttcacagggcattctccctgtatatgcatatctatgtccaaatttcccctttttataaggatgccagttatattgagttagggcctattctaatgacctcattttgacttgattagctctgtaaagatcctttctcctaataaggtcacattgtgaggtactaggggttaggacttcaacacatgaattttgggagggtaaaattcaatccataatacctgcatacataatgaagctagtctcttttccataaattcatacaatcatgtaacagttatgtactgagtgcctattaattacaatgttggtactgttctgggccctgctaggtacttctataccccacgtctttgtgaggtatagaagcagggtgcagtggcgggcgcctgtaatcccagctacttgggtagctcaggcaggagaattgcttgaaactgggaggcagtggcttcagtgagccgagactgcatcacttcactccagcctaggtgatagagcgagactctgtctcaaaaaaaaaaaaaaaaaggaaaaaggtaacatttgctgctgtcaacagataaaccctaaaatttaagtggcttaacaaatagatttttcttctcatacatctagtctgtatggatgttcctgatgggcaggtgactttccttcaagagtgattcagggacacaggcaactttcatcttgaatgggtcacttcccagatcatctgcttaaggagtattacagatgcaacatttttatggccaggaaatagtaaatatcacttctactcctactctattggctagatctcagtcacatggccagccacctgcatgggaagctgagaaatgtagtctagccgggtactcaagaagaaaagaaagtgcgtttggcatacttgcttcagtctcttctaccagttaaggtgctgggaaacttcaggaaatgaaagtagagtgcaaatatgttcagtctgtggtctgcttttaactactagttagaagagaagattgagtcagttcttgataaaacaaccgagaaagtggaaccatcagccaaaatattcacgtgaatttctgtaaacttaataatcatatcatgagaaaaatctatagtttttaatatgcattatatattgtaataaactatcttttgtacacaaaataaaactatgctattactaatagaatgggaagttgtaaacattttcttgattgtagctagggataactgtaaatttagtaatacttgactggctttgcaaccaattttttaaaagtcaaggttagtggaataaacctaaagttcacagtcttgttggcaaaaggctatggcgaatgtttacagtacatttttataaatgtggctttcttgcccgattttcaaaatgtagttattacattttagcctaaattctgcctctcctggctgttatatgattagttcactagacatccacagcaccaattatatccttaggccaaacaaaagagatcacctaactcccatttggtccttcaggtaatttactcaggtcccgttatctgatatcaaagtcaagttttatgagagaaaaaataccaacaaggtaaatcccagtagtttggaggtgaattaaaaagctcccaaattagtacttccctcaaatgttaaataattcactgtagcattatagatacaagactccagcaaaagttacacttgaacaattaaggaagcaagagctaaacaaatgacttcaggggtagagaaacaaattaatggtttctcatagcactataccaaattactttttcacattaacaagtgtgtaaaacacccaaacacccccaatgacctactagatgaagtttgattatagaaaatagcctgggtttacatgccaggattattccctaaatgtaactgtggattctatacacttgagtataaagcccatttatgttatttggaaaggtttcatgttcacaacgtacccctactcttttccaaagttcttttagtcaaattgcttggattataatgaccatctgccaacatgttatgtgaaggaccaaaagcaatgaaattgtttcctagaggctagacaagaattagaaacacaaggttacatcacagtgcaccatgtgcatacagattaatagctcctgctgagtagaaagagtatacactttgagataaaaatgggatttcaatcccaactctatcactttctagctaaaatatttcagataagtcaacctgagtattagcaatctcttctgtaaaataggaataacttacttatgtaacaaatatttattgaatatttactatgtatcaagtagtattttgcaaggattattttaggattagagataaaaaaaatagtaggtgctcattatctgtatgtgtggttatccaaatatacaagcagatgactaataagaaagggtcaaagtcagcagactgaaaatcaatggaattcctaaccgaaaacagagatatatgggatacaaggcaatgtgaggtccatttgctttccagggactaacaggtagttagtactcactctaaatttttatatattttctctagttatctcaactaaacttagccaagagttttctacaaaatttataaggtaaacttttttttttttttttgagacagggtctcattctgttgcccaggttggaatgcaatggcgcaatcttagctcactgcaacctctgactccaaggctcaagcgatccttccacctcagcctcctgaatagctgggactacaggcacatgccaccatgtctggctaattttttatattttttgtagcgactgggtttctccatgttgcccaggctggtcttgaactcctggactcacattatccatctgcctcagcctcccaaagtgctgggattatgggcatcagccatcacacctggcctgtaaggtaaacttttgagctctaactcaagcaggttttgggaaaggatgtagatgtactaaagatgtgccaaagagttttccatttaaaagtttttaaagatatgcttacaagatgactttttttaacatactaatttaatgctagtctgatctataactgaaatacatatatattttgaaatagattagaaaggtagaatgtaatcaagaaaaaaaaaaccaacaatgaggtttggagggaacatgagaactacagttagagcttcaactctccccattaccagttgtgtcaccagaaaaagcctcaaaatttttgaatctgttttcttgagtaaaataagcttaacaactcttactatggcattattataagaaccaaatggaatagctgtcataaaaatgcttagtaacctaaaagcactaaacaaatatgaaccatttcagagtgaataggtgatcacaagacatcccttatagtgaagggtatttgtatggatgaatggtaaaaggtttacaaaaaattatattggctggaggaatgggcatttgtagtcacaacagtaatcatttcgcttgcttgctaatgaggaaggatcattgaatttctggctggcaagcaacagtaatccctaaatattatggaacagaaaacatttatggacaagaccactagaaataaaatttaaaaaaaatagatttatttttaaagtaaatcaacaaggtcaattagccataagtcaaagttcctagaaatgcttcttcttgtgaggaaaatttctttatcacccatattgttaggctggttttaatttcatatgccaaagtctacctgttgattgttacatctatacaggcttttaatacagtgccaagcatattgctagaattaagtaaaattattgctgacatactgttactaaaaatatatccagtgatttttttaaacaaaactgaaaattttaagtttattttatatgcagcaaaaaatgagtaatacatacttacaaatttgttttttaatctaaatacatgagatgtaaaaattttttaatccaataaccagtaaaaaagtagactacagctcttaaaatgacagtagcatcaatctttatacaatgaggtattattttatcttattttattttgagatagagtcttgctctgttacccaggctggagggcagtgacacgattagggcttactgcaggcttaacctccctggcctcaagcaatcctcctgctttagtctcctgagtaacagggactacaggcacataccaccacaactagctaatttttaaattttttgtagagatgagggctcaccatgttgtccaggctggtctcaaactcttggtctcaagtgatccaccaggcttggcctcctaaagtgctagaattacaggtgtgagccactgtgcccggccaacaaggtgtcattttgagtagatttaaaaatcatagatcctgaactaagtggcacagaggtctctacagagacacaacaatacataataaggggagggagaagtgatgaacagaaaattttaaatgcccaaagtagaaaggaaagtatttcacacaaatgtgtgaagaaatttaccagagttatgtgtagagttggccaagactatcacttattatgaacaataaaaatccatttttaaccttatattttaatctatctttgaatcagagaatgacaaagaatggtgatttccactgacctctgtccagtaaaagaaaacacgatgtagagagcaatgtcaaaagactaaattcttcttaccatgagtagatcccactgaccatgtcatagttctgacatgaagtgttcacgctgctgggcccagctgctttagagataaggagcaccaccaagcccctcaactggaggctattccagctgtcatgtacaagccccctgccaacaagcaaagaaggaagaggattaatataccctcacgagatcatcagataacttagaaaactgctacaaagatgcccacacttctaaaactggacaatgagacttactgaaaagaaacagggtcagggaggaaaattaatgtgaggatgccatgagttcaggaaacaactagagaaatctacggctgcgttgttgttgttgttgttgttgttgttgtttttgagacagggttttgctctgtcacccaggctgagtgcagtggcacaatctcaactcactgcagcctcaacctcccggtcctaagcgatcctcccacctcagtctccctagtagctggaactttaggtatgcaccacgatgctcagctaattaaaaaaaaaaaaaaaaaacgtagagtcagagtcttgctatgttgcccagactggtcttgaactcctggacacaagcaatctttctgccttagcctcccaaagtgctgggattacaggcgtgacccaccatgcccagcccatggccagttttaaaagcgacaatctcgctggtggcagtggctcaggtctgtaatcccagtgctttggggggccaaggtggtcagatgagcctaggagcttgagaccatcccagacaagatggtgaaaccccgtccttacaaaaaatagaaaaataagctgggcatggtggcatgtgcctgtagtctcagctactcaggaggctgacgacggagaatgatttgagcccagggttgggggggtgctgaggctgcagtgagccatgatggcgccactgcactccagatggggagacggattgagactctgtttccaaaaaaaaaaaaaaaaaaaaaaagtgacaatctcacatttgaggcttcctcatttgctctctcctctttctgggtctccccgctgtctataccctatctcacaatcttaatcatttgctctggtaacaagaagaacccatagttttaaaccggtttgtgacagttgaaagaaactgacatataaatcacattgcttggatgaagtgatactatttggtgatgacggtggtaaacagtagtaaaaaatgatttgttttcacaggtagagaaggagctcagagaatgaaaggattaaaccaaattcaaaagacgcagaaatttgataagtaaatgaaagtgaatgccatcagcaaaaatgttgcttattacttacaaacattataattctaggcaacaacaaggctttaacttagaatgtggcatatcttttgacatgaggactgaatttttataatttctgctatacctgaggctagaaatacttcccaggaatacattttctttttaaagtattacaaatggttgtcattcaagaactaaatggcattgttttaaaaaattagaaaactatgggcaatatattacagtaaagtcatattgagaacaatgctcatgagcactaatcaaatagattacagcatatataaataatatacaaatatagctctcgaatgcagtaagaaaacaaaaattagtgttataatacttgactgaattatcaaggcttccttgttgagtttttgaacaaagaatcaatttaagttaattaaggtaacatagccaaaaataatgaattagtccattacttaagaaaaatcttggttgggtatggtggctcatgcccggggtggggggggtggggggtggggcatcacctgaggtcaggggttcgagaccagcccggccaacatggcgaaactccgtctctactaaaaatacaaaaattacccaggcgtggtggcaggtacctgtaatctcagctactcagggggctgaggcaggagaatcgcttgaatccaggaggtagaggttgcagtgaattgagatcgagccactgcactcccagcttgggtgacagagcgagattccgtctcagaaaaaaaaaaaaaaaaaaaggaaaatctttgcccctccagtctccaaacagaaatttttaaaaggggccccttttacctttcattagtttcaaaataagacaaatcattaggttctctgcaaagtaacagctatagctttctctgcttatattctgtccttaaccaagtaggcaatcttcatcaagataaaagggtttaaactgatttttaaaaagaaattctaatttcctaggaaaaggaagttaaagtaatacagttacatcacaacagaaacaaataatcatcagaaatgtcccaaactctttactgtcatgtaacaatctgcttaaatcctatgaacctgaattttacggcggttaagaggcatcctattacagaacacaaaaatgttaaaagaagagctttttaaatttttttttgctttgaattacaacttttaacttaggctactagattcttatttatgtattacctatagtgaatctttattcttcctttcttttataataaagagaaggtctgaattggctttcaattctagaaaaggaaaagaaaaagaggtgtgtggtgtgtgtgtgtgtgtgtgtgtgtgtgtgtgtgtgtgtgtgtgtgtgtgtgtgtgttcggggctgggcctggtcagggattaaggatatgattcagcaagaactctaagaggtgaaccttgagacaagtctgaccaaatcacacagatttaacagccctgacaacagttttaacaatatcttcaaacttctcagaaataggacctttcacataccacacacacacacacacacacacacacacacacacacaaataataataatagcagcagcaaacacttatattgtggtttatacattgctttctatatgtcagaaactgttctacatgttttactatatattaactaaattaattcacaatgctaagaggagggtactacaattatcctgattttacagatggggaatgaggcacagagagaaatcaagtaacttgtctaaggtaccatacctggtaggtggcagaaccatgacagagccaggatttgatcccaggccaacaggctctagagtctacatacacttttaaacattatgctatgtagtgatgctccatctgcttcctttgtacaaaaccatttgctacatcaaattagaacagttggctttagaaccagacaagcctaggtctgaaaaagtcttctgttatttactagctgtgagtgtgactctaaggctatgacctcttgtataaaatgagggtaacaatgtctacttttcatagtcattgtatggaagagacaacataggtcaaagtacataacactgtggaagcacatggttggtgatcaagtaatcagtaaattacattttctttccttgttacttttttgtgatcttatttttttctcaactcttaacattttctttcttctactctctttctccttgtaactctcaaaaagtcttccccactctactagcatatataatctcctatgttatttagttttctacctcctcaaataacaaaagttaaggaattcttcccaccccctaatcattattatcattatctcaatgataatcatgaaaacacccctttcagaatgcattactgaaaaggtcaggaaaagaagctgtaatgaactgggtgacaaaaattaagagagcattcagaaaagcacatcttctggccattaattttcacataagtcagtggttaacaatctggaggatagactaacagcttgagtaaattaaataactgtttccaaaacaccatttctttaaattcacttcgttaacactcttaaaaaaacagtactgaaataagtggataatgcctacagctcaaaatttagctcacaaccaaaagagaatatgaaattttgctccagagcaaataaaaaacaaacaaacaaacaaaaaacatgggattctaaacttacagagacaatatgtttcatgtagcacaggtcatatttcatctggaacactctaattttttctcagtgcttctcttaagggacactgacaagctgtggcataaccagaaaatggtgaaatcacataccaccacatctaggaaggctagcttagaaaatggtaaggttggtgttctcaaacgtattcagccaagagtgtactgaatgctcactgcatgccaggcttggtgctaaacagacagtggagaatatgatgaggagcactgttaagatgtggcctcccttcttgtgtatagtagtctggatttaaaaatcacaataaaatgtggcaggaattgtttcaggggatgaataagggttgtggcagcatgtagaagaagcaactaacacaattcaggggatgtcaaagagacttccgtgagatctaaaggatgagtgagagggaagtagccaggggatctggggcagggacgaaaaagtgttctgaagagagaaacagtatgtgtggaggtccgaaggaaagagaggaggacacagttgtttctagagccagtgtggcaggaacacagtacgtaaaggaagaactgagagaaataaatctggaggggcacaggagagttgtctgttcttttaaaagggttccctatgtagaggagatagatctagtaagtattaattttttttttcttttagagacagggtcttgctatattgaccaggctacttttgaactcttggcctcaagtgatcttctggcctggcatccctaagtgctgggattacaggggcgaaccactgagccaggccgtaagtattactttagagactgatgctaatggacacaaactatagcaggccaattctggctcaaagaaataaaaaacagagcaacctctggtaatgctgagctgcttgttactagagatgtttaagaagctgcacggactctgacataacacattagacagaagcctggaatatgtgacatctgaggttgttttcttactctgtgattctatatggcctcactttactacatttaattatctaatactccacaatatatacaaaaattgaaaaagccttgtcattaaagtgtcataaatgaaagcagtatttagtattttataatctttatcattaaagttctacagaattgggttttcttagctaatgaacaaaaacatcatttgttcattcattcattcaattaataagactggacgccttctatacatcaagcattgtgctaggcatggatgcaatggtgagcaaaaccaggcatggagcttgcagagcttatggtctaatggaagagactggtaataaaaaacgaatcatgaggacgtgtaaaactacactggtaatagatgctacaagggaaaaagagcaagagtgccatgagagcttggaatacagaaagtaactttgcaggaaagtcagtcttccttgaggaagtgatgactgagttgatatccaaaggaaaaaaagggggagtgggaaggaaacaggtaaggggggtatatttgcagcacaaggaggggcatatgccaggctgagagcactgtatgaagtgaaactggtggcagacaggaactacaccacccaggatgaacagaccataagaggtttgctctttatccaaagagcaattcaaaggtgctgtggtattttattaagcagccagtgacataatcagatatttcagaaaacaaaacaaaacaaaatcatttatcatcagtgtagaaaatgacttgtgtagacaagagaggaggaaaccaagggagtatgaggaacccaattaggaaacttttgtaatagtcaataaaaaaaaaaaaaagagggtagcttgatggacaaactagagatgtaccaaacctaaaataatgttgattcaactcaaaaagatgttgcatactacatagtcctggaaaattagctaatataggcatatcactaattttaaataatattattctaaatatgtttgtaagttgaattttaggtggggagatcttggcctcctttaaagttcttctctagatctataatagataaagagtaaacactaataacactaatattctaaaagctaaacaatttcatgggaataaggattgagtaggtaaaactttgggcaagtcagctctgtcttctccattgtactttagatggctgactgcagttctcactgcatcatatccttccacagctactaacaaatttacattccttcatccaatcctgtattagatcctcaaaccaccactgtggtacttttctatttatcctcttaaattccacttcaacacgtatgaagggtatacaaagaaatacgagctgtaagaaaagagctataatagtagattcaaagtatggttaaattgaataatacaaggaacagataacaaagaaaagttacaagcagctatcagtgcacaactagttgctagaggtgtccctcacagtagaggcagcattcagattgagcctgaaagatggtcaaatttccctgagtagggaacagaagtaggagacgggactggaatggagtcatgggaatagaaagaagggtattttaggagaaagaaatagataagcagtgacaagaaggtggaagaacacagaaccagttcaggagctgtggggctacccatttgggcaatgtgtgaaggtaaaacaagtccaggaaaacagacaacctaaagagtgaagggccttgaaagtcaggtttagagtctggacttaattctgcaggaaatctggaggcataagtggtttgtctgcaagggagaaatgtaattagagctaaagactaaaactgttactctgagcctaatcctgttactctggcaggtgctatgttgtgtacggtggaaaggagaaggaagatcagttaggaggagcctcttctagtagtccagatgggagataatgagggcctaaatgagggtagtggcaatagggatggggaagaaaagctgaatgatggcagtagcatggaggtggaaaaggctagtgtggccaactggagggatgaaggagacattggggagggatcagaaagcaaaggaatgtaagattccaacctgtttgctggaggtgataatgctaccgttagtagagattggaaagaaggaggagaactaatgaggaatgaatgagttcagttttggacatgttaactttgaatgcaagaaggacttccagatggtgatgccaagcaggcagctggaaatgctgtgcctatagagttgggaagcatcttcatagaagcgatggctgaagctgtaggaactgacagatgagcttttaggtgagagagaaaagaaaagaagagaagggaagggaatcttggagaattcctacacttaaaggaatgagatgagtaaccaacatgaagaaatatgttctagctacaaacaaataaaaggcctccacagacatggataatgaagtatgtatacacacgcacaatggaggcagagaactacaacagtacaatgcacagaaaccagggccagtagttgtaagcttcttccatgggctttcatggacttactataaacctctagtttggcacttaacacactgagtaataaaaatggtaacaatataacaacaactataatatactataatgccaggcatctgctgttttacatgcatatgctctaattctcacaaaaaccatgcaaggtaactagtaatatccctttacaaatgaggaaaattagcatggaggctcaaaaaagttcaataattactactcacaatagtcaattagtaacagaggtgccaaaatttaaacataattggactccaatgcccgggcttgcttatgctttgaggccttggtatttaattatttgttcacaggactccctggcaaggttgtgagacccttgaaggtactcagtcctctttggatgccctgcacccagcagagcaactgacacagaatagttctaaaaaaaaaaaaaaaattaaagatgagagaatgaatagcttcaaggagtaggccagccaactctccatcttacacatctccccaaaacagacctactactattctcaactttcctcatttctcttcctgttatcaatttgccacatccaaccattcagctctgactggttcctcttcctcttgagttccttttcctaaattgtagtaagttctttgaaagtgacaggcacacacaagaaaagccccaacacattctaaaaaacatgctgagatttgttattttgacgttgtattttaaaaattactgtatataaaatgtatgccgtatcaaagggtctatttaagttttagagaaaactcaacatattaattatatatttaatacaaatatttatgtgttttgtttcttcatttaggagaactgactgaattgactgctgcatcagtgcttgggaaagaaagctgccctcactctgaaaagaagataagtgtacttccagacagagagttgaggtggaaagacagaattggggcataaaagaaaaattttgagatttatgaataagagttcaaaattctaaattctatcagcaatccaaattacaatcttttgataaatttataatcaaatattaaggaaacaacttcaccaccaccaagggaccatcatccttgagtaagctcaaaataccccaaagtaaaactgagtgggaaagaatcaccttgagggcaaggaacccctttcaatgttaaaacctagagatatagagtgagtggtacgattttatttttatttttttaatttatttcttttttaatggagatggcaatgttgcccaggctggtctcaaactcctgggcttaagtgatcctctcgccttggccttccaaagtgctgggaaagtgagccaccacaccaggtcttactattttattaccccactttccataaatccagttccagtaagtctatccaaaaaatgtaagcacaaaagatggatgtcaaattctaacatacatgaagtgggttgattggtaagattcctattaatgcttatgactgtgacccctagttaaattttttttttcatttagatacagacaactgaaacaaaagaattgactataatgtgcacagtttctgccaaagaactacaggaatactctaatcttttctactcctttttaaaatgctgactgcaacctgctaaattgatttgtgacccaccaacaaggtgcaactgtagtttttttgaaaaacagtgttttaagttacagtatatgatgtattagttaaaagaactgaaaacataatgtaaaattaaacaggaatagaatcatcactttttaaaagcagaaaatctgtccacacactagcacaaatttagtgttgcaacaaaacattaacgtttacttaatgacatgggaaaatactaaaaatgttaaataaaagaatacaaaattgtatacatcatatgatctcaattatgcttcaaaatatgcatacatatatacatataaatgaggccaaggacaaaaactagaaataaatatgtcaaaaggttaacattttaaacctggtgtcattgtataggtgttcaatacacaaagtattcttgcatttttctgtgtgcttgaaatagtgtttaaaaatgaaaagaaaaacaggataagaaaaaaatactaccaaacggtaacaagtgttatccaacaaatttcttgattaagggtgacctatttcttaagttgcacacaagagcacagatatctttttaagactggagaaaaaaacactgtattttaaaaacaacagaattctaagaagacaaatgacttagtatattatagttgtgtttctaacttgaagaaaaaaaattaagtgacatttaatgaactccagagccctatggtatagggacccttttgggtcctactacttcacttttaatttctctgagatttagacacaggaccaaagtttaaatggtatcaatgaaatgatgttaaaaacataaatataattagcaatttgatgacagcaatattactcagttataaaagaaaaaaacactccatgaaaattatttttttaaagaattgtaattttagagagactaaaaatagtctgcatgtcacagatttttatataaaattagcagaagaactggaggttaatttccatggaaaaaatgacccaaaatgtattattactgccatatctattctaagactaaactgtcccagacttgaaacaactttagggcctgaggtgaccagcctttagaatacaggagctgtggcagtcattgatatggctcgagggccacacacacatcccacctgcattaaatcctcgagggacagcagggccaagaactgcctcaccaaagccctcccaaagcttcaattaggtttgatgagcatgtggcagaagacaggtgcctggaaggaaaggaaggaagagagaagagaaagtagaatgggggtagggtgcaggggttgttgagcagggactaaatcaagccaggaacttttcagaaatggttactgaccactagttgtatactgaaatataactgaaattaaaaagaagtataaaatgtcgtgatcaatcatgtttgcagcaagatgtggctagtcaccctggaattaaatataccactggaaaaacaacaacaaagatttccccactgaaatggtaactaaagatttaaaaatactaatggaaaatagggccatttaaaaagtaatatttagtcacactgaaaactctcaaaataatctcatacaataatttttacatctaagccccttgggttcacattttaaaaatcaatttagtgttgaagcaagggggtagaaaaattgagtgtaggaatacaggcatcattacactacacaacacacaagactcacaccaccactcaagcaatgacactggctaagagctaatgtgctgtgaattacacctcccactaccacagcccgtctgtgcagagaataaatcaaccgaatgtgaatgagtattcccttagtactcagtgctttcctcaacttgcagttccagtttcaatagaatctgccattcaaatgcaagagaactactcactttaatagtctataattttttatggttttactcatctagtatgtaggcctgtttttaccaaaaagaatgtttcaatgtaagtaatcaatatttagtgtatggagtatcagtcctattagctaataatggaatcacatcaattgtgcaaaagttagaagatttgtacttgaacaagtggaaagagataaaggtagatgattgttcaactgacaattactcataacatattatgaagaggctaaagccaaatgtaaaaaatacaacagcagatggatgaagccagtaaaaatcaggaagttgggggaaatgatgaaatactttatagagtaacagataatacctcaagggcaaattaggggggagggggaagagcaaagtgaaatacatcatagatttttagtaggaaaaatatgtttaaaaatgaatggaaaaacattcaaaatgtaaaactatattattgcaacatgatggttcagaagttcaaaaattttaggaaaatctcgtttatttttccagaatcaacattgaattcaaggtagaggagaccaagacatgaggaaatcggaagtgacagtgatggcgggacacacatttcatgtattcattttccacagaaaaatttccaccagagaaaagattccatgactggctgcctaagttcaaaccttagctctcataatcacaaatgtgccacccaattaacattaagaccttacagatatttaaaatggccaccagcagagctagcaaagaggattactataatagtcgcatctctcaaattatttatgtccatagaaaaatataatttgatttttaaaagttacacttacatggcacttattgaatagaatggcacctagtgaatgaaaagatatgtacttggaataaattacatacaggttattctagccaattaagcctcagagaacagtatttgctctatcctagcaggaagaaatctctcatttaccaaattgccaggaagctgcaggggcaactgtttcatttaccatggtatcctcaagctttctaaggtgccatctcatctaacctgacaactgtccgtgaggtggtggttatccccattttgttgatcaggatactgaggctcataggaataatttattttttccatatctattatttgatatactacatatttatagcacatcatttattttgattattcttcttccttgattagaatataataatcatgttatagcatatttacttgtctacagttatatctctggtgcttagaatagtgcctggcacacaggacatttaataaatacttgtttagtgattaataacacaacctgcctaaaattatttaatgtatatccaataagcgagagacctggggtccaattcaggtgtctatctttaaggccatgttcccccaaactggaaagataatgattacagcagaattaaaatatgaaaagtaaaaaggaacaataaattagaattagagttttaaaagtgccttataggtaaaaactgtgaaacattttaaaaaatatttttctcctgaacatttccttgaatcttctcttgcttataggtctggtgtattgatagagttcgaccagcagaggtgtgcaggctcctgctttataggcatgttcaacaaggctcccaggcagcacacaacagagggttggtggcccatgaaccagggatcaagggaagccctgagtagcccccattcccacggaggctgggaaaagtctgcagtacagtgaaagtgctgtccaggttaaaacaaaaacaaaacctcacagactgcaggagtagccagggtctaccctacagccaaggagtgttacatggaaatgaggacctgcatgggcccagcttgcagcatatggccctgtgcccttccggtggtctgtggcagctgatcctttaaaatagtcaacttccatacaattccctaaaattatatcttcttttttttttttttttttttttttgagacggagtctcgctctgttgcctaggctggagtgcagtggcgcggtctcagctctccacatcccgggttcaagcgattctcccgattcaagcgattcaagcctcagcctcccgaatagctgggattacaggcgcctgccatcacgcctggctaactttttgtcttttcagtagagatggggtttcacaaagttggccaggctgaactcctgacctcgtgatctgctcgcctcggcctcccaaagtgctgagattacaggcgtgagccactgcacctagcctcctaaaattatatcttttagggaaggaggagcttacgcttttcttcgttcttttctgaacaccatgggttctttccttgatgttgggcagaatgtgaatttctcatgagaaatagctgactgaatggctaatcaaaagaaataatttatatacattatatgtttttatttccaggaacatactaaagtaagacaagatatctgtatttgaaacctaacaacctatagattttaactggctttttgttcccatcttaatggctatatgttgtcctaattaatattaaaacaattaatttttaaaaggtaaaaaagagtaaaggacaacactatagctataaaggactaggaaatgttgaaaatgttatggtcatcaccggacttcatctcaggatgccatcccccaccccccacacagttttccttcctgaaaagttgccaggcatgagctgaaaatgatagcctttatttcactaaaaaagtaataggagataagtcatcgatcccctcctacaccccaaataagacaatggaatttctggatatctatcggcctatcttttcgactgactttttttggggttaaggtgatgggcaacaggagtggcagagtagagagtatgctaatgtttttatagcatatactatgagctatgcactttcacatgcacacaacaactctgaagaaggtactgtggtcatctccatcttataggtgaggcttagagacaggttagcgtcttggccaatgtcaaaagcaagtgaaagaatcagaattcaaaatcaggacaacttgactccaaagctgctaccttagttactaagttatttgttgaagttctttggttcccaggaaccaataatgttgagtcattgctattactccaatgtgaaagggctgatggaactcaggagtgaaacaaacagggtaagttttgtttattattggtacaggctaaaaagcctttaaataatcactggaatattaaacttaaatcaaacagctatggttaatagttttaaacccaaataaaaaaattaatatctacatttatttcaatgtgttgacctgtagcacaatgttcacttcatgtttctaaactgaaatgtttccatcagtacaaaggccatattataacaacagacaaataataaatagtccaagcttctaaatactgctaatggatacaccagcgactcaatgttggccactttatcccagaaaggtaaaagtatcaaactcaaatgacataatagcgaatatctattgcaggcagtgctcttagcatttttttttaacttacttaaacttcacacaagcttgtacagtactactgttatcctaattttacagatggggaaactgagacacaaggaagtaataagtggtagagccatgattttaacccagggattaggattctagaaccttcagctattctcatccttcctttttgtaaacaatctcaaacttatagaaaagttacaagtacaaagaattcttcttttcctgaggcatttaagagtcagttcctatcttggtacctcataaccatgggatactttagggtatataaattacaaataaggccgggtgcagtggctcacgcctgtaattccagcgctttgggaggccaaggcaggcggatcacgaggtcaggagatcgagactatcctggctaacacggtgaaaccccgtctctactaaaaatacaaaaaaattagctgggcgtggtggcgggcgcctgtagtcccagctactcgtgaggctgaggcaggagaatggcgtgaacctgggaggcggagctcgtagtgagccgagatcgcgccactgcactccagcctgggcgacagagcaagactccatctcaaaaaaaaaaattacaaataagaacattcccctaggctgggcatggtggctcatgcctgtaatcccagcactttgggaggccgaggcggatggatcacctgaggtcaggagttcgagatcagcctggccaacatgatgaaaccctgtctctgctaaaaacacaaaaattagctgggcctggtggcagacacctgtaatcccagctactagggaggctgaggcaggagaaaagcttgaacccgggaggaggaggttgtagtgagccgagatcgtgccattgcactccagcctgggtgacaagagtgaaactcagcctcaaaaacaaacaaacaaacaaacaaacaaaagaacattcccctaataaccacaatacaaccatcaaaatcactaacgggaatacattactaccatctaattttcagatccaattcaagtttcaccaattattccaataatgtcctttataacaaaaggatccagttcagaatcatacattgcatttagttgccatgcctcttcggcttcctttaatctggaaccgtttcttaactattccctgactttcatggcctttacaatttcgaaaattacaggccagttattttgtagaagttctctcagtgtggattttgatgtttctctgtgattagattgaggttttacatctcaggcgggaagatcatagatagaaacaatgttgtattcttcccacctcaatttcagtttgttccatgacagcagatttccactttggccgtctgagtaaggtgatgtctaccagccttctccacagcaaagttacactttccccctttataattagtaatgttttgtgaagaggtactttgaaactatataaatatctcattcatcacacaccagagcaggaaaaacgttggtgggtacttacaatgagttgcctctcttgatccaatatggcatcattagctcaataaaaacaaaacaaatcaaaaaataaattgagaagataaaaatgtatttctgtagagacaatgtaaattttcttaaatgaataaatataaagagaacttatgaagtttagctgataagcaaatgattcaacagtgaaagtttcaggccaggtttagtggctcattactataatctcagcactttgggaggctgagggagaaggccaggatttggagactagcctgggcaaaatagtgagatctcatctctacaaaaataaaaataaatgtgaaaattagctgggcatggtggcacatgcctgtcatcccaactactagggaggctgagatgcgaggactgcttgagcccaggagttccaggatgcagtgagctatgatcacaccactgtgctccagcctgggtgaacagagcaggaccctgtctcaaaaaaaaaagtaaacaaacagggaaagtttcaatatttcagacagtcattatcttttccctgggggaaaaaaaaacaaaacagttccacatttagtgaaataataaaggccacaaatacagattttgctttaaatggtggcttttaaaaagatgatgcaaaataaataaggtcttggattaagcaaagggggagaaactaggaattatacacaaattaatttaaataaagtcaaaaattgtttccaccacattaaaagtaaaaaaaaaaattgataaaagtaatgggaaaaaagtaattactctcttcacattgccaatatagttccaaacattatgaagttgaggacaatgataaaagatgaaacctttgtctctgagcacatctgtccaaaaggtaatgaatttcagatatgaataacagatatttgtatgcccaaatgtagaaaatgacttctcttggtataaagttctaagatggttttgttaacaaatacagctgtattgtttgtatcatcttgatatcaaaagttctgctcttccccaagagtagccagaccaatactaaatttaaggatcaggtgaatatttaatatttcaggattattttgtttttattatttgtgtatgggtagaaactagcaaattatcaacagattatttaagcctatcaagatgcttgactatttagaatatggtcctcatcttcaaatattctttacttaaatcaatgccttgtgaatggttctaacttgcatattactcaagagctgaaaagttctctataatatataagcacaatcgccactatatacactggtttccactcagtctggtttcaaatactgtgatataaatactgtgcaagctactgcctacataaaaaatagttaaaatttcagtgtaattattttacacaattatttaagtagatctgaaaggtctaatattctcatatttccaaaaaagctattattctctatatctgcattcttccaaaatgttcttttaactaatcatatagtgagatccagtaatttcctaccaaatagcattaacacagccacatattgatatacgtttctgaaacaatctatcagatgatggaaaaatattctcatatttttgtgaaattttaggaaaatgagctaataagactttttgataaagaaacttcatgaacagaaacttaactttattgattcagagacctgaattttacaatatcacagttttaaaatgttgctaagaaatgtatttagtattgaagtaaaccatcataagaaaatttcccaagaatacgtcatgtttttcaaaaagaacagaagattaaccataactgttaagttagtattgctattatgagtttatctttaaaatattctttaactttataaggatggaccatgactgactatctgctaatgtttcaatataacagaaaaaggttcacacaaacttaactatgctaaatattcctacacaagtcagcaataggaaaaacagaataagctgagtttggcatttatggatgaatacatgcaaagaatatggacttcctcccattttttatatactaaactcagtagaagattctaaaattctattaaaaattctcttttatgaatatgtaattttagtacaacttaattaccccatttgtttcattatgctgcaaaatagttttcaaactcctggatataagagggctttcacaatacataggttcaccttttgatataccagtaactgaacaaagctggagagggtagttggtattcaaaaacatggtggtaggggagacagcatgtgaacagcaagaggtgatgtacaaactatttctaccagaaaaaaaattaaactggctggttcatatagagaagtggttcttaactcgggtgattttacctttctcctttcccacgaggggactttggcaatgtcaaaagagatatttttggttgccacaccttgggggtggaggggtactagtgccatctagaaggcagaggccagggttgcttttgaacatcttataacatacctgataggcctccccctccctcacaaagtgccaaggttgagaaactctgatttagagaatccatgtgtacttatgagacttgccccataggattataataaagcctaaatataaacatttagcttataaaacgctaactatactccttgtcacaaactatgtgctcaatatgcactagttattactattatcagaattactattgttatccatatagtcaatgctttttggcttcagtgaaagctggaacagatgcaatcctatgtcatctgccccactgtaaatacatcaagaataacttttaagacactgaaaaaaaaagattttttaaaagactatggcaaaaagctttttgaatgtctatacagacaccaggtttgtataaacaacacatgtggatgtacacaatcattttagattaggaaaaatttattctagattaataagaataacaataaagcatatattttacttctttcttccctaggcaacactcccaggaatagcaactgattttatttacagttattacaacaaagtattttttaatagccatgctttaaaaagtcataaccattctatttaaagcttaaagccaattactctccttctgtaatttttctcatattagctaatatgacagcaataactaagcatggtaagccattggaactacattacaactgcctttgctccccagatctcatgtaattatatgttacctcttcagccttcttttgcttgttacatcaataaaaagtttttctgaagaagcaaagtctttacttacaaaaagataggtggcacccctcaatatgatagcattaacactttcttcccagttctcgaaagtgccaaagattctcaaattaagaacttctcaattaaattcatgaaatcctgaggcaaaatatcagcttagatataaatgaattttaacagagtaatgccttttagaaaatcactggaaaatttaaaatgtatttttctattctttttctcagggaaaagcttatgattttaaaaggttggagaatttaagcaaacactcagtagttttggaaatgtagtttccatggcaaccaacatggtcttctttatatagcattataaacagatggtaaagagtggtcatgtttgtttctctgccagtatatcaataaaactactatcgtactgtattgaatacacttgaactatttaatgaatttaatatactaaccacaagatgtactaatttagactgatgtaatgaattttttttttcttttaaataaacacatgaagatcttgaacagtgaagtcactatactccatatactcaatagtctaccttggcaagactttgtacaaatgttttctcagcacttgccatgcagggcatataaccacaaatattaatctgacaaggagaacataatagattgaaataataaaagtgaaaccatgtctgtaattatattcctttgccatcttttcttaaagaacaaatgagaaattatgaaacaggaagagtttctttacaataaatgataggatataaagcaaagggcaaaattgctgtttaaaaatcagactccattccatgtacacagcggcagctttcagaaatacaggtactctgaattccactgttttaactgtggtaacttgctgggtactatttgcttaaaaactaaaagaagccaagaaactataaatgtgattagtctggcagtgaagtctgaagagccaattcctgcatgtattatcagcacatgtgaagcagcgaccctgtatctggaagaaagtcagtcagtcagaaggggctgtacagtaggctggggctccccagggaaaactggcagtctttttcacaggctcgtcttagagaccttgatctattttccaagctagcttgaggatccttaccttaaaaaaagctgggtcaatatttatgattttaaattatataaatagccatttttattatacctgcaaaataatatttggtaaatggtatctgtcctacattctcccttttataaagtcctgttttcatgcacccatccctaaatttgctaatttttagcacttttttctatttttttttttgagacgcagttccactctgtcaccaggctggatggagtgtgatggcatgatttcggctcactgcaacctccgcctcctgggttcaagcaattctcctgcctcagcctccccagtagctgggactacaggcatgcgccaccacgcccagctaatttttgtatttttagtagagacagggtttcaccatggtctcgatctcttgaccttgtgatctgcccacctcagcctcccaaagtgctgggattacaggtgtgagccatcacgcccggccctttctatgcttcttacatcaaagtaagttaattagaagtgagatacttcattgtgtgtaacaatccatgatggaaatacagaaaatgggtatgcatatttttaaaaggtgtgaatttgggtgatgtacagtatatatggtttaattgaaaaacaaaaattttcaattgaaacattttaaaactggcaaagactgtactagatttatatttgactcaaaaatgggaaaatgtctgctacattatgtatcttagataaactactgtcaattctggcctaccagaaattgctaccataatacaatttttgaaaattatttaaacctagaaaatagtctttctcatagaggtgagagtctccaatcaagctcaccaccccaaaaaagaatacctgagtgattccacaaccagaagcccttttcagagggttttcagtttgtcttcttctatagtacttgcagcgtggaaaaccatctagaaactgatagctcttagtttaacttaacttttttcagaggtacctgtgtaagagagattctcagtcctggctgcaaaacagaattacttgaagagctttaaatataacaatagtcatatcccagcatatgccaatttaggcaggatttctgggagcggggccacaacacccttcacgtgtgattctaatgtgcagccagggtttaaagaaaacaccagagagactgtgacttgtttctctttatccctgatgaggaagagatctcaagtcaccactttgatgtctacaggacacacaattcagtgttagatttcctcttcattatagagaggcacaaggctgaagaaaaaggcactattatactccattatttggtatagtaaattttattggaaaggagttcaacaaaataccagactgaggtatgaaaaaactttccccatgaactattccaaataatatttagcttttggccagattaccattattagaaagacttgtgaacagtgaatttactttcactccttttgggaagccctcagtgtttgagctggttatgatgtattctccacattgaacaaaataaatgctttctgggtttccagtgtacttagacattctgaagaacggactgaaataattagcattgtaattctcacattatttcatggacatcatactctcttttacaaaaatgaccttaaaacctatcaccaacagtaatgaaaattcaggtgtttggagaaggagaagctccagaggtaaggaaaacaccttccaccttttttctgtagcacacatccaaaaatgttaaaaacctgttaatatactgtctcctaaaaagaataaaaatgaatgtcatagatcataaatgttatttcaagccacaaacatttcttatttgactacatgtctatctggtagattgtggtaatagttctttatctatatggttttctcctttcaaattatttgcaagatcaatgacttatttgcttgatatgaaatagtaaagagaaataaaataataaactctccaaactgtcagtgatataaaacattaagagggtagagttaaataatctcagaaaataaaccatgacaataccagagtcttaaaattggtttccacatttttggtttgttttcttacatttctacaggctactaaaatttccgcaagtcatttattctttccttgagaaactttatttggctatttgtgtgtctggtgctattaactcatcataattttacatcaatcctcataacatgattgaggtttaattctaaaaaaattcagaacacacaaaacaggaaaaaatatcactctaatgcattttggaacaaacagcctattaaagagaataagtgtgtctggcagaattctagagatgacagaaaacgaggaaacaacatttcttaatgttatttaaatatgcgcacaggagacagggagatgtgctaggacacagcatcacaggaactctagtcttcctgcacataaaatagggcttcattaacaataaaggaacaggtgtcttgggacccatttatacaggctattaactattatgagctgctggtatccaaatttattttagtactaggcaactgattaaaaataaatacaaatttaaattccatctattagcatgagaaagcaatgcctagatttccagagtctaatttaatataaaggtatttttctatggtcctaatcacaggaggatacttaagttcatatacagtattttctaaatctcaaaataaaagctttcctattaaactttatttgaatgtaaaaaaaaattgatgaatgaccttttatcttgacctgacaataccaaacaagctttatttactaagaactaaatttttattcaaatgtaaacaaataatgacacaaacatgcatccattttttaaaaagtaggggaggaaatcaaacataccaacctccagctctaaattcagtgcattccaccacattttatactacttattttgaaaaactgagtggcaaccgttattctctggcaattttttactgtttcatctataaacaatgataaagaatttaaaattttgaactatttgaggaatctttacattttattaaaagatatttaaaatgctagagttggaactgcagtagtgataatcttgtccatcacacttttttacagaacaagaaaataaggcacaatgaggctaagtaatttagccaaggtaaacatagcaatattttaaccacataaattgtcaaaatactattacactataaaatcagtataatactggttgagcatccctaatctgaaaattcaaaatccaaaatgtttcgcaatccaaaaatttttgagtgctaaaataatgccataagtggaatattctatacctgacctcatgtgacaggttgcagtcaaaatgcagtaaaaaatttgtttcatgcataaaattattaaaaatactatgtgaaattaccttcggactaggtgtataaggaaacaaatgaatttcatgtttagacttgggtcacattcccaagatatctcattatatatatgcaaatattgcaaaactcaaaaaaatccaaaatccaaaacatgtccggtgccaagcattttggataagggatactcaacctgtagtacgtatcttccaagtatgttctgaaaattaaacagggtaacctatttttgatgttatttcaaactgctatattcatctatgtctagttaaaaacaatttttggtttattcacttacataatgttcttatagtgatattttttccacttattccagaagtgttaggtgattattctacacttcttgtgccacattctatggagaataaagatggtacaacatttgatctatatccataagtagccagtaaaagccattgcagaaatgatgaaaaatttgagactgaggagaaagccatggatagaatcataattcttaaaaatatggcaacattttaaatgaaaataataaggccagggtttctcaatcttggcactaatggcattttgaactggaactttgttgggaggggctgcgcattacaggcattatatttagtagcatccctaacctttacccactagatgccaatagcacccccagttgtaatagccaaaaatgtctctagatattggcaaatgtccccaggagggcaaaactgcctttggttgaaaaaaatcacaggataaggcagactactatcttttgattttcaaactgtgatacatgcttaatatcatctagaggcaaagcaaatcaggagctttagcattctcgctctttttttttttttttttttttgagatgagttttgctcctgttgcccaggctggagtgcagtggcgtgatatcagctcactgcaacctcagcctcccaggttcaagtgattctcctgcctcagtctcctgagtagctgggattacaggtgcacgccatcacgcccagctgattttttgtatttttagtagagacagggcttcatcatgttggccaggctggtctcaaactcctgacctcaggtgattcacctgcctcagcctcacaaagtgctgggattacgggcatgagccgccgcacccagccagtattctcttaaagattacttcagatctagccaggagcagtgtctcatgcctgtaatgccagcactttgggaagctgaggcgggtggatcacttgaggccaggagttcgagaccagccttgccaacatggtgaaaccccatctttactaaaaatacaaaaaattagctgggcatggaggcacacacctgtaatcccagctacttggaaggctgaggcatgagaattgcttgggcccgggaagcggaggttgcagtgacctgagattgtgccactacactccagcctgggtgacagagcaaaagaatgtgtttaaaaaaaaaaaaaaaagggagagagagagagagataacttcagatataaggcatcaagcattaaaatacctgagtatagaaataaaatcacatattcaatatcaaggtatggctttggttttgattttgtggttttctgccactaacttctgaaaagtccaaagaaatatgaaaagtcctggaggcggggggcggtccttgatcctgaggagagatggggatctttcatattaaggtttctcaaattagaaattgctctccctcttgcccaagaaacccttagtacatcctttcctattctttcaaaatataacatgtcattttgttgacacataaattgcaatcaagtacaattccaggctggtgtccagaagctagccattcagtccatgtttcacccatccagtgacctaggagcattaaaactatatggttttgttttgttcttggtatataaattttgtgggcaaagaattgtcataaaaccacctcaaatttcacactttccaaagatctcaagaattgtgaaggtttattatactggagattgctaaaatgttagatcaaggcgcaaataattgaggtggcaagcaaatattaggtctacaaaatatatgaagaggaagagctgacctcctctgtctcatgcatcttcctgtgtattctctcttctctagccttcacacctgctgaagtataaactgaacaactgcttggtaatagcagtacctcattaaaaatgtggtgcatagagtctgtggaagtactctagaaaaaggcactaagagagaaaagatggaaaggaatatttgagaattagtgaccaaatgtgagttggcttgggatcaaatttaaaaagaagtaggcccaccagaggcatagtttatgagataggcttgccattagaaccttctctgcttctagaagcctacaagctctgcattaaaaaccaacaaaaaacatctggataactgatgaatttcgaaatcataatcactaagaggacagtgttgctcattttggttttgccttcacttgaaaagttaccaagtggtctcaatttctcatactcaacaaacttttgtttcttcaacattgtgaaagaagagagcggtctgtgttttcacaaagggatgcctacaggctgaaaagttctgttattactgttttgttttgactctatgtatagtgatatctccaacattagaaatttggacataatttgctaaatctgaatttacatactgggcagtatttcctttaacaaagtctaattggaacagcattttatggtacatgaaaatttaattgcaaatgttagagatacagagaagtctgatttatatagaagacagcttatttttagttggaaaaaactgcaatgccaaactattttgcatttaatgctataatttacatatattataatattcatgatatatgataaatacccaaatcctatttggaaaaccttcattgtgaaaaaaattagaattttaacaaaatggtgtctcatattttaaagactgttctcatttttaaaaagtaaacataccaatttgataaaagatattaaatctattactaataaattcaggttcttgtggtatttcttgaattctaaatattgaaggtaaacaccagatatatgccaataaatttctaaatttataaaatcagcaccctgcattttaagtacatacttcagacatttcacacaggtacagggttaatttaacaaaggattatttcattataacaggcaacgtgctgccacaaactacagaggaagagagctctgaaataattgatgctctctgacccatttcatttttcaatttgtgtttcaaggaaaacttcagggttgacattttctacttgaccctacaaatgtcttttctctccacttgggcaaaaaaatcatccatatttttacacaattaaactacgcccctaccacccctgccctaaaagactaccaattaaggccatcattactcaacataaaacataggatcacacatgtaacactatccaaatcactggtgctttaaaatgtacagatagagacttccatttatcatgatggaatgaggtggttgacaaatcctccctcaaaatgcaactataaagctgaacaaaatagtcaaaagcagtaatttgagcactctgcaatccaaccacttcattagaactgctgaacttcagagaagaacaatatgagtttaagacatccttgccagcagctgctctcacctccatccccttgctttatcagcacagtagctgaatcagtgcagggtaggctgtgaaaacaagcagttttgtttcaaagctttgtcacccctgccagaggaggctcacttgattttgaagactgcacttgattttgaggactgttagttaaaagtactgatggcctgtggcatcacaagcctgaataagcaaacctgacgggggcaggcagcagacaaactagccaaatatttaacagggaattccagcaaccacagggagcttgaccccacatatttacggttgaccaggctgtgtgcattgccacagagaccagagagggcccatatatccctggctgatggagcctgcaggcatgtgcaggtgggacatgagaggtcccaaaaggaaataaaacccagagcagcctgaagtttgaatgtgctccgaagctcacacacagatccatcaggagagactggaagtctcactgtcttaaggtgtttcagcgtaacttctgaccagtctttggttgatcactaagctatgcagacacaaggacaacaactaggaagccagacttacaaataaaaggaagggataaaatagtgagaagagacgtcacaactgcacattgtgaaggatacagacttcaaaggtttagtccaggcaagtaataaaactaacaacaaccaaggtcaccaacagaagggaaaagtgagaaactagagttgctacaatatattgtctaaaatattcagtattcaacagaaagttaggagtcatgcaagaaaccagaacatatgatccatacaaaagcagtcattagaaactatctctaagtgtctttaagatattataagcaaagggttcaaaacagctattataaatatgctcaaaaaactaaaaaccatatttaaagaattagtaaatgactcagtgaatacagagtctcagtaaaaagatagaaaatatttttaaagaaatcaaatggaaattctggagatgaaaagtttaataactgaaatgaaaatatcaccagagagtgcaatagaggatgtgaaatagcagaaaaagaagcaataacttggagatagatcaatagtaattatttaacctgaataacataggggaaaaaactgaagaaaaatgaacaaagcttcagagaactaccagacaatatcaagcatactaataaaggtgtcattaagagtatcagaagatgaggaaaagtgagaaaggggcacagaaaatacttgaaaaaataatgggcaaagacttaccaaatttgatgaaaactgttaatttacagaacaaagccattcaactaactcaatacaggacaaatacagagatatacacatagacacatcagagacaaactgttgaaggataaattgtgttcggaattggtgggttcttggtctcactgacttcaagaatgaagccgcagaccctcgcggtgagtcttacagctcttaaggtggcgcgtctggagtctgtcccttctgatgttcagatgtgtttggaatttcttccttctggtgggttcgtggtctcactggctcaggagtgaagctgcagaccttcgcggtgagtgttacagctcttaaggcagcacgtctggagttgttcgttccatcccggtgggctcgtggtctcgctggcttcaggagtgaagctgcacatcttcgcagtgagtgttacagctcataaaagcagcgtggacccaaagagtgagcagtagcaagagttattgcaaagagcgaaagaacaaagctcccacggtgtggaaggggacccgagcgggttgccaatactggctcgggcagcctgcttttattctcttatctggccccacccacatcctgctgattggtagagccgagtggcctgttttgtcagggcgctgattggtgcgtttacaatccctgagctagatacaaaggttctccacgtccacatcagattagttaagatacagagttttgacacacaggttctccaagtccccaccagagcagctagatacacagtgtcgattggtgcactcacaaaccttgagctaaacacagggtgctgattggtgtgtttacaatccttgagctagatacagagtgccgattggtgtatttgcaatccctgagctagacataaaggttctccacgtcctcaccagagcagctagatacagagcgtcgactggtgcactcacaaaccttgagctaaacacagggtgctgagtggtgtatttacaatccctgagctagatataaagactctccacgtccccaccagactcaggagcccagctggcttcacctagtggatcccgcactggggctgcaggtggagctgcctgccagtcctgcgccgtgcgctcgcattcctcagcccttgggtggtcgatgggactgggcgccgtggagtagggagtggtgctggtcggggaggttcgggccgcacaggagcccatggagtgggtgggaggctcaggcatggcgggctgcaggtccccagccctgccccgcgggaaggcagctaaggcccggcgagaaatcgagcacagcgccagtgggccggcactgctgggggactcagtacaccctccgcagccactggcccgggtgctaagtcccccattgcccggggccagcagggctggctggctgctccgagtgcggggcccaccaagcccacgcccacccggaactccagctggcccgcaagcgctgcacgcagtcccggttcccgctggtgcctctccctccacacctccctgcaagctgagggagtgggctccagccttggccagcccagaaaggggctcccacagtgcagtgggggggctgaagggctcctcaaatgccaccaaagtgggagcccaggcaggggaggtgccgagaacaagcgagggctctgaggactgccagcatgctgtcacctctcaaaatcctgaaagtagcaagagaaaaatgactttatcatgtacacaggaataacaatacaattaatggtttatttctcatcagaaaccatggagaccagagagcagtgaaatcaatgatacacttaaagtcctgggggaggcggggaaggcttggcagctaagcctttgtataccctgcaaaactttccttcaaaaataaaagtgaaataaagataatggaagtgatattagacagtaatctgaatctacatgaagaaacaaagagtgtaaaaaatagtgaataggtgggtaaatgtaaaaaaaatctgtaaatacatttttctcatttcttctcttaaattttataaaagatatgattacataaagcaaaaattataatggacttataatatatagaaatatatttaacaatagtaacacaaatgaaaaatagagatatattggagcaaagtttctgtattttgctagaattaaaatgggtattattctgaagcagactgtgataaattaagatgcatattttagcccccaaaacaactaggaaaataactcaaaatcatacagctaaaaaaaacacaaattgaaatcattccctaaaatattttcatttaatacaaaggaaaggagtaaaggaggaacagagaaacaaaaataacatgagaaaaaatacaaaataattagcaaaatcagacttacatcaaaccatatcaataattagatcagatatgaatggacaaaacaacccacttaaaaagcagggctatccctgcttttaactggatttaaaaagcaagacctaactacatgctttctccaaaaggcacactttatagaaaaagacggtaataggttaaaagtaaaaggtcagaaggtgatatgccatgcaaacagtcaccacaatagagctggaatggctatattaatgtcagactaaatagacacttagataagaaatattactggagacaatgaaggacatttcataatcataaaggtttatcatagttttcataatcatcagtatatcataaagatataaaagttttaaatgtatatatacctaacaatagagaccccaaatgaaacaaaaactgaaaaaactgaaagaagaaacaggcaattcaggaaaaatagttggagaattcaataatactctgctttcaataattaataggacaactacacagaaactcagcaacaatatagaagactttaacaacactatcaaccaacttgatataactgacatttatagaatactccacacaatgagtgcagaatatgtattcttttcaagcacacgtggaacattctcatatgctgggccagaaaacaagtctaatacattttaaaagactgaaatcataaaaagtatgttctctgaccacaacacaagttaaagatctcaaatagaaagaaataggggaaaacccaaatattttgaattaaacaacatacttctaaatagcccaggggtcaaagacgaaatcatttaaaaaattttaaaaatatttccacctgaatgaaaatgaaaagacaacatatcaaaatttgtagtgtacaactacaggagtacttagaggaaaagttatagcatattctgaggaaaagtgtcaaataaataatctaagcttccatgttaagaaactagataaagagcaaactaaccccaagcaagcagaaaaaaagaaaataataaagtttacagtgaatatcaataaaacagaaaaaagaaaaacaataaagaaacaaatcaatgaaaccataaagtgactatttgaccaagaaaataagaaagaagacacaaataaacaaactcaggaatgaaaaaagatcacattactgaccctataggaattaaaaggactatgagggaatataatgaacattactctatgccaacaaaccagatgacttagataaaatggacaaattcctagagagtcagacatttccgaaacttaagaacacacagaaaatatgaataggactatttatatttaatataaataaatacatttataagtaaataaattgaattattaattaaagtcctttccacaaggaaaggcccaggcgcagatggttttgcttgcaaattctatattttagaaagaaatactgattcttcacaaacttagaaaatatagaaacttcccacctcattctctgaggtcagtacttaccctaacaccaaagccagacaaagacatcataagaaatgaaaatgacagattaatatctctcatgaatgcagacacaaaagtgctcaacaaaatattggcaaactgaatctagcaatataaaaagaggctcatataccacgactaagtgggattcatcccagggatgcaaaatcaagtaatgtcaaagcacgatgtaggctgacttttaagatcaagtatttaatatccatattaataaataaaggacaaaaaacacatgaccatctcaacagatgcagaaaagcatttaataaaatacaacacctattcacaataaaaactctcaatatgtgagaaacagaaggaaacttcctcaacctaataaaagatatcagtgaaaaacctaccactaacataaaatgaaagactgaatgaatgcctcccacttaggactgggaacaaggtaaggatgtcagttcaactcaatgttgtaccgaaagtttcagccagtgaaataaaaaaatttaggccgggcacagtggctcacgcctgtaatctcagcactttgggaggctgaggcaggtggatcacttcaggtcaggagttctagatgagcctagccaacatggcaaaaccccttctctactaaaaatacaaaaaaattagccaggtgcggtggcgggcaagtgtaatcccagctactcaggaggctgaagcagaagaatcgcttgaacccgggaggcggaggttgcagtgagctggaggttgcagtgagctgagatggtgccactgcactccagcctgggcaatagagtggaactctgtctcaaaaaaaaaaaaaaaaaaaattaaagacatccagatagtaaaaggaaggagaaaaactgtatttgagggtgatcatctatgtggaaaatactaaggcatctataataaaaaatactagaattaatacatgaatttagcaagatctcaggatatatgattgatatattaaaaaactattgtatttcaggccaagcgcggtggctcacgcccgtaatcccagcactttgggaggtcaaggagggcggatcatgaggtcaagagatggagaccatcttggccaacatggtgaaaccctgtctctactaaaaatacaaaaattagctgggtgtagtggtttgcgcctatagtcccagctactcaggaggctgaggcaggagaatcacttgaacccaggaggcagaagttgcagtgagacaagatcaggacactgcactccagcctggtgacagagcgagactcgtctcaaaaaaaaaaaaaaaaactattgtatttctatatatcagcaacaaataatcaaaaaatcaattcacaataacatcataaagaataaaatgctcaggaataaacttaaaagaagtgtaaaattcgatgctgaaaaccgcaaaactttactgagataaagaagatctaaataaactgaaagacatttcatttttacaggttggaagactcagtattgttaagatgtcagttctccacaattgatatataaattcagcacaatccctatcaaaatcccagaagacttttaacagaaattgataatgtgggccagtcacggcagctcacacttgtaatcccaccactttgggagggcaaggcgggaggattgtttgagcttgggagttcaagactagcctgggcaacatagcaagaccccattctctacaaaaaacataccaggcatcacaggcacacacctgtggtcccaggaggctgcagtgagatgtgaccatgtcactgcaactccagcctggacaacactctccctctctcaaaaaaagaaattgataaggtgattataaatttaagtaaaaatgcaaagtgcctagaataggcaacactaccttgaaaacaaagaacaaaattagaggacttgtactactacctgaacttacgataaagctacagtaattgaagtagtgtagtattggtataatgataggcatagagatcaatggaacagggttttcagtacagaaataaatccttacatttatggtcaattaatttttgaaaaaagtgccaagacaattcaatgggaaaaagggtcatatcaaccaatggtgctggggcaactgaatattcatatatttatttttaaaacacagaacaggccgggcaaagtggctcacgcctgtaatcctagcactttgggaggccaaggttggcagatcacgaggtcaggagttcgagactagcctggccaacatggtgaaactccacctctactaaaaatacaaaaattagccaggcatggtggcgtgcgcctgtaatcccagctactcaggaggctgaggcaggggaattgcttgaacccaggaggtggaatttgcagtgagctgagattgcaacattgccctccagcctgggcaacagagtgagactccatctcaaaaaataataataaaataaaaaactaaaaaagaaaaaagaacaatgtagactcttatctcacatcatataaaaaattaacttaaatcaatcatagtccttagagctgaaattataaatcctctagaaaaaaccataggagcatatcttcatgacctttctcaacctcaccattacagagaattctttgttgtaaaggattgtcctatccacaaaaggacgtttaactgcatccctggctggctcctactcactaggtgccagtaccaatctccatacacagctgtgaaaataaaaaatcatctcaggccaggtgcagtggctccacctgtaataccagaactttgggaggccaaggcagaagaatcacttgagcccaggagtttgagaccagcctgggcaccatagtgagactctgtctctacaaataaaaaaattagctggatgtgggtggtgttatgtctgtagtcccagttacttgggaggctgaggtgagaggatcactcgagcccaggaggtcagggctgcagtttcttttgtatctcactccagcttggatgacagagtaagatgtgtttcgcaaagaaaaaaaaaaaactacagaaagaaacctaaaagaccttcgccatgagaaacagttttcccaactctgaaaaatgaacaacagccttgaacttctgagttgtggaaccccaaaagagatgaagtgataaaagagcaaaagagacctttgagaatatcacctcacttctagtagttagagttctggattatgctcaagagttttggcaggtttgctaacactttaccgaatcatcattcaggagttttagcacaaactactcgcaaggtctcgagtaattcagagaatattcaccagtcattattaggatatgtttcagtgaaagcatcagcaactcttcattgaatcatttacgcaagattaccttcaaaagtgatcccaatttgaagaaaaaaagaacatgcaacaatctaaatacactaccagattgtgacttctacaaagaatttcaccaaacaaagcttcttgatctgcagtttccattgtattcaataacatcagcaaaattaaagaatctgcaaaaatagtgtggtatggtttacaatgctgaattttaagcctgctatttaagcataacgagtgtatttcaaagataaggaagtgcatattaaagaataatgaaattttaatttctccctctctagttacaatgcaggatattcaagtatcaattttattcttttcccatttagcagacatcaattctagacctacacataacaactcaagaataatttatttttatcacctcttttcaagtggcagaaagtaagatagttcttgatgatgctcagaatatctggttacctctgagcatccagtctccagttcaaaataagaactatcctccttttttatcttttaaaatacagataaagtgaatgcttccagaaaatgtcaaccggccaggagcagtggcttacgcctgtaaccccagcactttgggaggctgaggcgggcagatcacgaggtcagaagtttaagaccagcctgaccgacatggtgaaaccccgtctctactaaaaatacaaaaattagccgggcttggtgggcacctgtaagcccagctactcaggaggctgaggcaggagaatcgcttgaacccaggaggtagaggttggagtgagccaagatcacaccactgctctccagcctgggcgacaagagcaaaactctgtctcaaagtaaaaaaaaaaaaaagtcaaccactggaagccaaagtaccaaaatatgagctattactgtaaaacatcattaagaaaggtctgtttgtaagttaccatagttattcaactcaaagaagtggacaaacttcttttcaccaaaggattggggtactcgaaattcaggtgtatgggaaaaggaaattgaatattttagattttcattctaactcccatataagaagaaatctaagactaaactgaatacagcaagagtaaaggacagtctcaagtggcaacttgagactatctgcaggttacattctcctgttttcatttatttcaactgacattttcccttacaatctactaaacaatgattgtagttcatttttcaaagtaaatgttaaatgcttcctggcatgttgaattaggtcacttcagagtgaaaatactctggtggaatataaaattgacaactataacattagtaagaattagtaagaatgaaggcagacagacagctccaagaccaagaaaaacctagctgggtcttaaagcattgtcgagtctaggacaccttagatgccagttccttgaattaatttacaaattaactaaattaaataatttgtcaaaggctgtaacaagaagggaaaaggcctaatagctgttgagttcctattctaatgctggcatgtgctaggaatatgtattatctcatgtaatctttataatcaccctgaaagaggatatttttcccaacttacaggtaaagaatctgatattcagaagagttaagtaacttacttatagttgaaccaaggcaaaattcaaaccaagaaactagactcttgttttttcttttatatctcagtgtaaccattttacacaatagagattttaggcttttaaaagattcaattaaggagaaagtaataaccatttattatttcctgatgttatggacttctattctagcaggcagtcaaggggggtagtcaccaaactgtgggctggaagcaaggtacccaggcaaagattttagcaggtaccagttttctttatttttttttcaccctggtttttggtttctctctcactgttgtacaccggtagtttaaaaaatcatgctcaataaaaataagtaaatcacaagactctgaagtacagctattctaagaatttctaggcacattgcatttagggtaaattcagaggaactgcatttagtctgggaagtaggaggaaaaggggttaaagcatgtttcatcagtatcatataattcttttttattttttattttttgagacggagtcgctctgtcgcccaagctggagggcagttgcgcgatctcgactcactgcaagctccgcctcccgggttcatgccattctcctgcctcagcctcccgagtagctgggactacaggcgcccgccaccacgctcggctaattgttttggatttttagtagagacagggtttcaccgtattagccaggatggtctcgatctcctgaccttgtgatctgcccgcctcggcctcccaaagtgctgggattacaggcgtgagccactgcgcccggccctagtatcacataattcttgccaaatcctaatccttctatattagagagtttaaaaatgttgatattaggttctaatcaaataagtaaatttaaaacagaatgcaaattaccactttcaaagtctaggtctcaaattttcatgtttctcaatgtatacaggtaattatagaagagtgccaaaactaaacctacacacttgacttttatttttgcctgacaagtctaataatctttttttttttttttttttaagacagagttttgctctgttgccaggctggagtgcagtggtgtgatctcggctcaccacaacctccacctcctggattcaagtgatgctcctgcctcagcctcccaagtagctgggactacaggcgtgtgccaccatgcccagctaatttttgtatttttagtagagacggggtttccccatgttggctcagatggtggtctcgatctcttgacctcatgatccgcccgccttggactcccaaagtgctgagattacaagcgtgagccactgcacccggtgtaataatccattttttaaagtatgttaatactgaataacttcttagtctacgaggcagagtaaaaatcggcctccaaaagtttaaataaatagagctaacttaagaaaataagtttaacttaataattttacttctcattttatactattatgattaatattacctataaacaggaaacaacgtgttaaatttatacctcaggacttgttctgaatctagagacagactgtagtcttatcttgttctccactgttgcttgtattctcacacattcctccaggaattctccagctgggcctatctactttttctacaaaagtaccatctataacttttacctaaagctgacaggagaaagaagtaaccctttttcttctcccttaagccacctgctagctaatgtccctctacaaggacctgattggaattaactcccactttctctctgccagagcccatagtttaaagcacagaagctacggttctggcaatcagtcaaatctcctgctttttctcactctggattatagatgaagtacaacagaggttctagcatggccctctgctccatttccaaaactagattactgcttaggacaacagggaaacacctcttttctcttatgcaaatgagtaagattttctcttctaaagaaggatcctgtgaacatcttaaaaattatcaccagctgggtgtggtgctcacgcctgtaatctcagaactttgggaggccgaggcacggcagattacttgaggtcaggagttcaagaccagcctggtcaatatggtgaaaccccatgtctacaaaaatacaaaaattaacctgccgtggtggcgcccgcctgtaatcccagctgctcaggaggctgaggcaggagaatcacttgaacccaggaggtggaggttgcagtgagccgagattgcaccactgcactccagcctgggtgacagagcaagactccatcacaaaaaaaaaaaaaaaaaaaaaatcaccaatgaaagcaactaacagcagctaatactcttatgtggtgttgctaaagttaatgctcagttaggtacaaaaacttaccccctcatccaaaccgatcaactgaactgatataatttttgctttttaaagtttagcatgtagttatgtaggttttatttagttcaattcctaaggacctactatgtgccaggcactgtgctagaccttggaagtacaaagaataaagcccagctgttaccaaatccatgtgcttaacacttagagtggttaggcacaggcaggaagaagaggggaggctagggcataaaatgccatgaacagtgttttcagtgccatgatagtgatttgcacagctttaataaacagtccaagaaacacttcctagggaagacggtgctggacgtaaacccttttcacagtatctttttctttatttttggttaatgttccttatattatctctttaatcattttaaacagtcatgttatagccctttcatgtttttctgtatctcaggttcctgaggtgctaaccttcctgcttatttttacttatggtaggtaaggttctcatatatttataatttccgattttgagttcactactaggtattattttctttgtggcaatcttattttttttaattaaagatcagtaataggaagatatctagaaaatccccaaatatttgaaaattaaacacaaatttccacataatccatgggacaaagaggctgtcagagggaaatcagaaaatgttataaattgaatgaaagtaaataaaaatataataatcaaaacatcaaaatttcaggaatgcagaaatttatagtattaaatgcttatattagaaaagaaagatttcaaatcaaagatttaatttttcattttaagaaaccagaaaaagagcgtaataaaccctaaaaaaagcagaaggaaaaataaagatcaaagcaaaaattgataaaacagaaaacagaaaaacaaaagagaaaaccaatgaaacagaaaatcttttgaaaagatatataaaccagatacacctctagccaaaatgattatgaaataaagaaagaagacacaaattagaaatatcagcaatgaagggataggactctgctgtagaccccacatacttcaaaaagataataaaagcatattacaaagaactttatgcccatgcattcaataacttagatgggatgaacaaattccttgaaaaacactatctatgaaagttcatgtaagaagaagtaaaaaaactaaaacagttcagcccagatgtcttcactggtgaattctatcaaatatttatggaagaactcataccagcagctctttcagaaaacagaagaaagcactacctacctcattttatgaggccagcattaccttgatactaaaaccagacaatgacaaccctgagactaaaaccagaaagagacattacaggaaaattattaaacaatatcctttatgatatcagatgcacaaatcctcaaacatattaacaaattatatccagcaatatgtaaaaagaatgatacaccatgaccaagtacagttatactaagaacagaaggttggtttaacatttgtatgaagaaatttgtataaagaaaaatcatacaatcatctcaacagatacagaaaaagcatttgacaaaattcaacatccatttatgataaaagacagtacactagccagttttcagagcaccatttattaaatagggaatcctttccccattgcttgtttttctcaggtctgtcaaagatcagatagttgtagacatctggcgttatttctgagggctctgttctgttccattgatttatatttctgttttggtaccagtaccatgctgttttggttactgtaaccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattcagcagtggtttgtagttctccttgaagaggtccttcacgtcccttgtaagctggattcctaagtattttattctctttgaagcaattgtgaatgggggttcactcatgatttggctctctgtctgttattggtgtataagaatgcttgtgatttttgtgcattgattttgcatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttcctatgtagaaagctgaaactggatcccttccttacaccttatacaaaaattaattcaagatggattaaagacttaaatgttagacctaaagccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatcagacaaagggctaatacccagaatctacaatgaactccaacaaatttacaagaaaaaaacaaacaaccccatcaaaaagtgggcgaaggagatgaacagacacttctcaaaagaagacatttatgcagccaaaacacacatgaaaaaatgctcatcactggccatcagagaaatgcaaatcaaaaccacaataacataccatctcacaccagttagaatggcgatcattaaaaagtcaggaaacaacaggtgctggagaggatgtggagaaacaggaacatttttacactgttggtgggactgtaaactagttcaaccattgtggaagacagtgtggcgattcctcagggatctagaactagaaataccatttgacccagccattccattactgggtatatacccaaaggactataaatcatgctgctataaagacacacgcacacatatgtttattgcggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgggaactgaacaatgagaacacatggacacaggaaggggaacatcacactctggggactgttgtggggtaggggtaagggggagggatagcattaggagatatacctaatgctaaatgacgagttaatgggtgcagcacaccagcatggcacatgtgtacatatgtaactaaactgcacattgtgtacatgtaccctaaaacttaaagtataataataataaaaaaataaaaataaaaataaataaataaatatattacaattaggcccttaaaaaaaacgacagtacactggtaaaagaaggaagcttcctcaacctaacaaaaaccctatagccaatatcatacttaattgtgaaaaaaatgaattttccccctaacatttggaacaaggtagaaacatccactcacaccaccactattcaatatcatactagatctttcagcaggtataataaaagaaaagaagacacacgggctgaaaatgaaaaaatgaagctttatatttacaaatgtcatgattatctatgtagaaaatcataaataatctattaaaacctgttaaaaccaataaatgagtttagcaaggttgtatgacataaggctaatgtatttctatatgctagcaatagacaattggaaactgaaaatctaaatgtaatatcacttaaaatagcactgaagactgggcatggtggctcacacctgtaatcccagcactttgggaggccaaggtgggtggatcacctgaggtcaggagttcaagaccagctgggccaatataatgaaatccgttctttactaaaagtacaaaaattagccaggcatggtggcaggcacctgtaatcccagctactgaaggggctgaggcaggagaatagcttgaacctgggaggcagaggttgcaatgagccgatatcgcaccaccgcactccagcctgggcgacagagtatccgtctcaacaataaaaaaatgtgttgttcagaaagatcctctactgaaatttgtctttttccctcatgattagactggggttatgagtttctggaaggaagaacacagcactaatgtgccactttcatcatatcataccgaaggtacataaaatcgccatgatttagctctgctgatgttggctgaggtagtgtttatcaagtttcttcaccgtaaagttactccccaaccatccacacacatactcttggaaggaagtcactatgctcaacccatactaaggagtcccggggaagttatgcttcctgtccttgggatagggtatctatacaaatcatttggaattctttggcatggaagatttgtttcttttcttctctttattatttattcaatcatttatatcagcatggactcatggatatttatagtatgctttgagtatttaaaacttataaaataatatctggctttattgcattttgatcaggtcgtataacatttctgtattataacacttatctgatgtttacttttgtgacctgacatacaatcaagttttgtaaacatttcatgtgcacttgagaaaaggatgtattttctattatcagaacttcgagtttaatatatgtacagacctacctatttggctatgttgtttaggccttctcaaaaatctatccttgctgatttttgtctgtcttatcttatactgagagtgatgagttaaagtctcccattattaattagcatgcttatgtctctttgtagctcttgtattttttgctttataaatgtggttgctgtgttatttggtgttaaatacacataacttgttatctttattttgaattgaagtgtgttcttcctcatgtttaatgcatctttagttctactttggtatcagaataataactgctgctttatatgtgtttttctatttttctggtattcttttattcatgtctttgtttttagctttttaattcatgttgtttaggtatatattttctatacagcatgaaatttattttactgccaaattgaaaatactttttgttaataggtgaagtgagttagggctattcataattattgataatgattaatatatttggtctcaacatattatatattatgtataatatgtttttctgctatattttctttctctattatcagttttttttgaattttaaaaatttctgttatatttagaaatattttttcttctgtactagtgattttgtgttttactgtaaatagacctctaatgtaaggatttacgtttaactgtctaggagttggcctgtgtttaaagtttgttgtagctgtaggtgtcagaggcttcagtttcctctagtgtccctgtttttgtctcccctgttatctttgggtttccctagaaactccttcttaaatagggtctgtgtcttacagctctctcagctgtcatctactcttaatttactggagctctgttgacgtggtaggaaggtattgtggaagggaagcaatctatactcctataattaaatctcagtattgttagtgtttgtgattccttgggttctgaccttcagaagagtttctcagtctttttccccctccctttatgttagacagaaaggccatggtggggtaaattggtagtttcctttgagggctggcctttgttactgagaacactctgagagcacttcaaagtggatcattttcctttccccttgccaaatgcatgaggggatttttcccagatcttcaactttgaaaggtggtagtatccagcctgggagtaaaactttcatgaaagtgtgggggcctccttagtttttaactctcaagttatccagattcagtctccagacactagtcaattatcatccaactaatcctgacagttcttgcagcttatgttcccagttagctatgattctttgtattcacctttctctctagttttcagagcagcggtttcccctgagacctcaattatctgataaatctattaagagttattgattttcagtttttcatttttttccttgttgtaggaatgggagtgacagcttccaaactttttacatgtgacaggagaaactggaagtcacaaaagatacagatttacttttctactatttctttctttcctcaaaagtagttaataatccgaattgaagaatggaatgtgctagaagtaaaaggaaactataaagttttattttagtgtgaaggaaagcagaaatcattagactgtgtcatcccctcatttccattatcagtctaccctatctacttctaaaatgtaagcaccctaataatgggagccttgtttgcctggccagctgcatccccagtgcataaaacaccatacggcacatagcacgtatttaataaatatttgtgttagatgaattaaccaggtaataaggtgcttttctcgactctaacctccataataaggctggaaaggagccaaatccagcccatctttcttgtttttgcattcatcatcaattgagacagaaaatagttttaaatcaaagagcctataagcatatgttaaatgctattaaatactcactaacaatagaatttcttcatggcaacagaaaactggctcatcctcttggtcattttggaaatgagattttttttaaacctcattcatagctatgttccattttcttaagatgctgcttatgtttacttactgtatccaaggaattgaagcattaaattcattaggtgttgtttaaacaagacaggaagtatagtcaaaggcataatttaatattttggaacatttggcacagtcaaaaaccaagtagactcctgattagatatgctgtgatccagtttcatgaaactcaactagaatgcttttactatgaaataacttttgcagctgaactttttgacttccatatcaggatgtcaacatatcctttaatatatttcatcctacttataaatatttcactataattatagcattttattaatttattttccaatatataagctagtatttgtaatgtgcaagtcaatatgttaagataaaaagagcttattgcaaattttttacagctacaggtgattttttcagaggtttaacactagctgcacagtttatacaaattattcgcaaaggaagatagcagagaacttactagaagctaatgtggaaaaaatttcaaatataactagttgagaaatttgaactttattctgaaagtaatggggagcctctgaagaatttcaatcagtaaaacacccagattatgtttcacaaagattatttaattcccttcactgcactattttttaaaacttatttactgtgttttctccaactagaatataaggtcgacaagactacagcacatatctgtgtattcactgttatatcccctacaccttttataatgtcaggtgcgggaggtaaacaaaaatggctgaaaagctaatacttttttctttccttttttttggccgtgaaccaccaccaccaccaccataataattaaagtcttgaacccaagaattgttagtgagggcacaaattagaacactctgaaaatattaaagagcaagaattaaacactggtgaccaaaaggatatgggcaatggggaaaagtaaaagcaggaatcttttacagtatttcaaaaattaccataaaactacagcaataaagacagtataataatggcataagggacagacaaacagatcaacagaatagatttgagagtccagaaataaaaacttatatttggtcaggtgcaatggctcatgcctgtaattctagcactttggaagaccaagaacgggaggatcacttgagcccaggagttcaagactagcctggacaacatagtgagactccctctctacaaaaaataaaaaattagctgggcatggcagcacacacctgtagtccctactgcttgggaggctgcggtgagaggatcatttgagcttaggatgtcgaggctacagtgagccatgattgtaccactgtaccccatcctgagtgacacagcaagactctgtctccaaaacaaaaaacaaaaaaaccttaaatttatggtcagttgatttttgacaaagacgcagagttcaatcaacagggaaaataatatttccaataaatggtatggggacaactgggtagccacatgcaaaaaaataaagttggacccttaactcataccatatacaaaaattaactcaaaacagggctgggtgcagtggctcacatctgtaatcccaacactttgggaggccgaggcaggcagatcatttgaggccagaagttcaagaccagcctggccaacctggtaaaacccccatctctactaaaaaaaaattagccaggcatggtggtgtgcgcctgtaatcccagctactaaggaggccaaggcaggagaatcatttgaacccaggaggcggaggctgcagtgagccgagatcataccactgtactccagcctgggtgacagagtgagactccatctcaaaaaaaaaaaaaaaaaaaaaaaaaaaatcaattcaaaatagatcatagatctaaatataagaaggaaaactgtaaaatgctattttctacataaaagtaaatcttcataagattaagatgctcttagacacagcatgagaaacaaaataaaaattagataaagtggacttcatcaaaattaaaaattttgtgtatcaaaggacaccatcaagaaggtgaaaaaaaccacccacagaatgggagaaaatatttgcaaaccatgcctctgagaagggacttgtatctagatacaaataaagaaactttcaactcaacaataaaaagaaaaataacccagttaaaaaatgggcaaagatatacaaatgggcaacaaggacatgaaaagatgttcaatgtcataagccattaaagaaatgcaaatcaaagccacaatgacaccaatttacacccattaggatggctaaaatgaaaaagaccaacaatagcaattgttgatgaagatgtggagaaatggaaccttcattcattaatgggattttaaaatcatacagccagttttgaaaagtttaaaaaggtaaaacaaagttactatgtgactcagcaattctactctacatatacaccaaagagaaatgaaaacatgtattcacacaagaacttgtaaactaatgcaacagaagcattttcataacagcccaaaagtagaaccaacccaaatatccattagctaatcaactgttacacaaaatgtggtatatattcatacactagaatattattttgttataaaaagaaatgaagtacaacatagacgaaccctgaagatattacacaaagtgaaagaagccaggcagaaatggacaaatattccataatttcatgtatatgaaacatccagagtaggcaaatccataaagacagaactaggggtagtgggtaaataggtggtgataattaacaggtaccgaggtttttttgaggggagtggtagaaatgtcctaaaattagatagtggtaatggttgcacaactctgtaaatacactaaaacccactaaactggctgggcgcggtggctcacgcctgtaatcccagcactttgggaggccaaggtggttggatcacctgaagtcaggagttcgagaccagcctggccaacatggtgaaaccctgtttctattaaaaatacaaaaattagcagggcatggtggcgggcgcctgtaatctcagctactcaggaggctgaggcaggagaattgctggaacccgggaggcagaggttgcagtgagtcgagatcacgctattgcattccagtccagccaacaaaagtgagactctgtctcaaaaccaaaaaaaaacacaaaaaaacaaaaaaaacccactaaactgtatacttaaagagggtgaattttatggtatgtaaattgtatctaaataaagttgttattaatattaacacacacacactcacactcacacaacttgtagacttttgaatagatcattctccccctggtgctttccgtctgactgatgcaaaattctcaatttccgcaaataaaaacacaaaaactgtccaaaatttatataggtctgaaagttaatttaaggaattattagaatataaagtccttgaaggctacaaaaatatcatagttctacttcccttcttcatactattttatacacagtaagtgctcaataaatgtctgctcaaatgaatcttcaaaaagagattagggagcttaaatgttcagaaagaagtacttttatagcaaggctttccaggtgaatactgacctctgaatttcatctctttatttagtctttggccagtttctttaggaagagagatctgagaaatctttagaacatgaccgtaatatagaagatactataattaaccttcctgcatttttaaattaaaaacatccttctgcctatagtcccaggtactcagaaggctgaggcaggagaactgtttgagcccaggagtttgaatccagcctgtgaaacatagcaagatccctgtctcttaaaaaaaaaaaaaaatcttcatacagaaaacctctatagcagagttaatacaaaacacaaaaaacatcctgttatcctcttggatcagggaatgaggtacgctggttaataccaattgactacatacagattagtacttactaaatgaatgggaacaaaatcacaacaagatcacaatctttcatggataaatcagaaaacatttggatatgttacactgccttagggtcattgttataatcaactatcattatttactatgttggactgcttttgcccatgtactcagtaaggaagtttcagttgaagtaatactaggcagaccaacttttaccacaggacattaaaaccaagagaactgacagctcaaccctaaaagctgaacatctttttttttctctctctttttttttttaaataaaataggcaattcacctgtctggatctttcctcaaatctgtttccaggtcctgcaaagtttacctttaaaaaagcatgattgtacatgagcaaaaatacatggcctaaatatgtgtcaggcttgcttactggaagaagggatataatttccagaaaaatacagtaacatgtctatagaaaaatcatatgtaggatgtaaagctcttacaaattaactgttaagtaaacagaatttctgccttagaacttcattaactatgttaaatgaaggtaagtttagcctccctttcctcatcctctttattctctagtgtgtcctctaaaaaggcatctttgagaaaggaagctacaaatttttgtccttaaaagtcaactcaaacacatttaaagaaactaagattgtattaattatttaatagttatgtatattcactaggcaaagaatctggcactgaaaaaaatgatccacttttcttctgggttcccatatacaggaatcaaaataatttacaaagatttgtacaatgaggaacagtggactcaaaaattcaaactttgtgatattaaaaagtaacttcatgtttattagatgtaaatagttttacattgtatatgtcattttctaaaaaaaaaaaaaacaaaaattgacaattggatcctatatttaagtgttatctgaacatgtcacagaacaatgttctaaggctcacagcaggattaggcttacatttaaatcactgacattatttggtaattattcatcttggataaaatctaatctgaccattcatgtcataaaaccagagtccacaaagttggaaggtatccaagaactcactagtgcaatctcctcatttcataaaagaacaaagtagggccaatcgaagttaaataatttgccccaaatgcccaaagatctcaggattagggtacagcagactgcaagctatactactttatcaatgaagctaactaaatcccatttgaccagaaataaatattttccaaaggcttaatcaattttgttctttcatcagagtttggaggaaaatataaagatcacctagcaatcacttttagtaatatgagaaaccttcaaaatatttctctagtacataaaacaatgcaaaattaaagaaaccacagaagtccaaagctagggttgtcccagctatccttctccaatagcaacaagatgcacaagaatgttacatctaaatttgacttaaggaaaggaaaatcacatacagagcaacagaataacttaatccacaagctgcttccttctcaaataagtctgaagggtttgtccatttttccaccaacctgttgcactctgctttggtatttctccaccattgcggtccacacattcccaaggagggtctgactacttagaccttgacatctggaaagttcattgttccccagcttctcctcaccacccgtgaaaaagaccagaaagattggttgactgttcttggagatgagatgacaggcctgcaggtgcacctgtagcctctgacctgccagtagaatcttcacttgcatgactaaagcagcagcttagatttccagaaatattagcagttttcatttaaactttctctagagaccctgggcagatgacatgaatgaactgctcaaaaatttcctcagcaaacctttaactctcatttttgctgataccattatttttgtaggaataagggagagaaattacagagacagaaggaaagaaaaattttaaagaaagaaaagcattatttgctgtgtaaaggcagttacccaaggctaatatgcagtgtgtcaaaggtataactgaaatatcttaacctgtaatccaaatccaaagaataaacatgaacattaaaataatactgaagcataaaggtctgaaggataacagatatccacagttattctgcaggaagacccatagactaagttggctttccagccctactgaccatccctagaggcttcaactgtgagcctggtagaaaactgtattagaagttgcaatgatttcattttctccatctcttgagatgctaggaaaggtccaaattacactctgagtgctggagcaaatgttacaaaaatgtacaaaattacttgtgatgtcactgaagaaagttagcagacaactaggagaagaatgtcatcaaaataaataaactctcaaagagattggcatgcattacatgattctcaatcctattcaatcaattacattattttagtataattatctatttccttagactaccattatttaaattagatgatctaaaaccatgctaatggggaaaaccctaccaatcaaaaaacgaagaaaagaaaatcctagactcaatttcctcaccccgacagccacaatgcataagaagagaagaaagaatatgtcaacaatatgtatacttagtagagcataagtttattatccagcccaggacactactgaaaatgaaaaaggacactattaaaaattataccaggcaaagatgcagaacaggaactctcattcattgctgatggaaatgtaaaatgttaatagccacttcggaagacagtttggcagtttcttataaaattagaaatagactcaaatacaacctaaaaatcatgctcctacgtatttattcaagtgaactgaaaacttacgttcatgtaaaaatgtgcatgtgaatttttttttttttttttttgagacggagtctcgctctgtcgcccaggctggagtgcagtggcgcgatctcggctcactgcaagctccgcctcccgggttcacgccattctcctgcctcagcctcctgggactacaggagtaggtgggactacaggcgcccgccaccacggctggctaattttttgtatttttagtagagacggggtttcaccgtgttagccaggatggtctccatcttctgacgtcgtgatccacccacctcggcctcccaaagtgctgggattacaggcgtgagccaccgtgctcggccatatgtgaatttttatggcagctttattcataatcaaagaactggaagcaaccacatgtcatttaaaagaagaatgggtaaacaaattgtggtatatccatacaatgtaatattatgcagtgacaacaaggaataacctactgattcacacaatgagatggataaatcttaaatgcattttgctaagtgaaaaaagatctgacagattacatactgtatgattccactcatactgtatgattttattcatataatattctggaaatggctaaagtaaggaatagaaaacatcagtggttgccaggggttgggagagtagagaatggtttactacaaaagggaatacaagggaacttttagggtgatggaactattttgtatagtactggggtagtgaatatatgacactgggtatttggcaaaacccaaagaactttacaacataaaacatgaactttcatgtataaaaagtttaaaaaatcagccaacaagttggcattcccaggatggaatgtagactgtgaaaaagaacctaactattataaatgtatgacataatatctctgagaatatgggggaaaaaaaggagtggacctaaataactttggaaaataatattttgactgtaaacagtaaggctagaggcaaaagaacttgtacatgaatactgtttcttacttggtaaagctgtttctcacaggggtatgatttaacatttctgaaactgctttacatgtatactacagtcgaacaaacaggtaaatagatgctacatcatagaagccagattactcactgttggaaagttacagataaactaagggggaaggctacaaggaatactgtggtattggattggagacagaattatcaatatgaattcatgtttaacttaatgtagatacacaaataattatagaaacatgtgtatacatgaataagtatacatacatttccttgctctgtctgtggagagggcctaggaataggaatgtccagaagcaatgatcatatccacaacccagatattggtttctaaataccactattcaattaaaaacaaaaacaaacaaacaaaaaaaaccatagctccttggagaaatggctacttctatgattaggctgggaaaatacaagataaaccagagtatcttgtagtaccagaaagtaaggaagtgttcaacaaaaggatggggttatgtcaaagggaaagagctcccaatggccaaagctggaacaatttgagcaacaaaataacatgttaatggagtataactcaaagtataaataaatatccctgagtccgtattgatacagataaatggggagaaaagagagatattccttacagaaaaattccaattaatttacacagataccctccaagagcttaacttacccccttgagtgtgggctagatttagtgactcacttccaaagaacagaggatgaggtatggggataacattacagtagagaaatctgccagacactaccttggccagatgatcaagattaacatcaacagtgataagtcataacgtaaaatgtagtcctgaaattatgtgaaaagaagggcaattcatctctgtatcattctgaaaaaccataaccccagtctacataagcaaacccaaactaagggacactccacaaaatagttgaccaatactcctcaaaactgttaaagtcatgaaaaagaaagaaagactgacaaagtgtcacagaatggggaaaataaggagatattacatctaaacgtaatgtggtatactgcattggatcctggaacagaaaaaggtcattagtggaaaagctggtaagatctgaataaagtctggagtttaattaatagtaacgtaccactgttgatttcttagttttgacaaatgtaacatgattatatcagatgttaatagaggaaactaggtgagggtatagggtataaaggaactctctaaaatgtctttgcaacttttccataaatctaacattattccaaataaaaagtgtattaaatatgtgccaagaaaatagatataagccagaatcatcctggaaacactaggacattatgctcatctgatgtatgacccaagtctacttttgctcttaacatcctttcagtgttaacaatctagagaataattgagtttgtgtgatttagtaataaatgaaaaatctaactggattctatcatagctatttttttaaccttttttggaatttctagctccataaaatacaaaataatgcttcaaataaggttccttgaactgatggggggagggtggggagaggaaatgcagaagatgatttgtgattaaaagactttttaatacttagaaccacctttttgctcacatttttatatttagggcctaagtattttattcttgtggaagagataataacatggctattggaaaagaaaccccatctaactcttaagatcagtggtgaaccaggaggcccacaacactgtatctacagctcatgagagataagaaagaaaccaaacagaagagttttttaaaaataccatgtgtaatgataagagggaataaagaaaggcagtgaaaactgactaacctccttctttcctggctagtaagaaatagattttatttttaaattaactctttgtataactgtctactgtaagtataaggactaataacatccttagagagctcctgctgccagaaatagtttctattccaagcaggggatggggggattacaaagcaggtacggaaatcatttgaaagcaaagatttttcttgatgctttaccccattcaatagctgtatgaggagggccaatgttttaggaagttattggtacttctagtatactaaaatggtataaacccatattatatttcctttgtggagggtggcaaactagaattactgccaaagttactttgtagtatgtctaatgtatcaatacatattataactgaacctattacccttagtttgcccacaaaatccatttcattcatgtattaaataaatatttactttatgtttcttatgcgccagcactttttgaatgcttcatagattttgaaaaaaaagatacatgctcatttttttttaagactcaagcaagtcaaacaagtacaaaaataaaaggggggaaaaatcaccctacaacctcctacccagaatttaacccttggtgaaaaacaatctagacatctctctttgccaggcacattaatacatattttataaaaaggattttagccattttactaatgggaaacatttctttataaaaaaaacaactattaagcttgatgtttataacaatattaatcctagactcttctattattaaaaatgacctgagaattcaggccaataaggcttcacctaaaacatacctaatagaacctttctctaattaaaagtggaccctagatgaaaataaacacaggtatacatgttttaacatcggccaagtgtaactttgcttgtatgtaaagaagctaattgggcagcagctctgtcagtatactgaagtagatttcaattggctgcctattttgagttaacccatagaaaataaaacagtcagatactgcttgcagcagtgaacggtaatggctttaaaaatttttttaaaacattctttaaaagagggtatacaacaagttgcatatttttcttgatctttagttccatgttcatctttaaaattctcaaaaaaaagttttcagtcattttcttattagatacaattttaaagtaacttgagcatgattcattagcttaaatctgacagagaaaaatgactacacataaggctttcacagcatctgaacttttaatgcataaaccatgtcaaataatttttcataaggaaagagcaaacattactgtcttctaaccggtaggtaatttcctcctcttccttttagtctcagttcatcagtattgatacaggtgacttgttgggcaccctgaattccatcctggcctccttcaacgttcccttcaatttactctagtgtcagaagtacaagcaaactttggattggccccagaacagttatacccagacttcaagcttggcactccccttcttgaaacttagcctgttttgattcctctcttattgtctcatatccaatacagtgtcctttataccaaactggggactgtccataactctacctattcttctcaatatcatttatgatattgatgggtctactgattttttaaaaaacagtatttggttttattcatttttctctatattttgtcttttatttcactgattctgctctatattactgccttcctttacattaggtttaatttgctcttcttttctcgtttattcaggtagaagcttagatcattattgtaaagcaattaattttcctctagtattgctttacctgcatcctacaaattgacatgttgttttttcatcttcattcacaatattttctaattttccataaaatttcgtattttacccatgagttatttagaagactattgtttaatttctaaatatctgggaattttccagatatctattatagtgaattctaatttaactctgttttcagtcagggaatacattctgtgatttcaaaacttttaaattattgagactttaaaaatatcacccagcatatggttaatctaagtgaagttctatgtgcacttaaaaaaaagaatgtttactctgtacttgtttggaggcatgttccataaatgtcaattaggtcaagttggttcatagtgctgttcagtcttctaaatccctatgaattttatgtatacttgttctattaattgttaagagaggagtattaaaatctcctactataactatggatttgtctatttcagttgtcagtttttgctccatgtacttcaaagctgttattatgtacatctatgcacattaagaatacttatatattcttgatgaattgactgttttatgatttatattagggtggtgcaaaagtaactgcagtttttacgattgaaagtaatggcaaaagccacaatttcttttgcaccaacataatacatgttcctttttaacccttgtaatattctttgctctgaagtctgctttgagattaatacagctatttcagctttcttgctatttgtttgatacatatttttctatctctttggtttttatattcaaagcaagtttcttatagacagccaagagtttcttgctttcatatgcagcctgaaaatctttgctttttatctggaagatttagaccacttagagttaatttaattactgatgagactgggtttaaatctaccatcttactatttgttttctgtttgttctctcttttttcctcgtttcctgccttcttctggattattttttagtattccattttatcttctctatttggcttatttttcaagtggttcttctaggatttggagtatatgtattttacttactgtattagtccattccctgcattgctatgaagaatacctgggactgggtaatttataagaaaagtggtttaactggcttacggttctgcagactgtacaggaagcataacaccagcatctgcttctggagaaggctctggaagcttacaatcatggcagaaggcaaagcaggagcttgctcatcacatggcaaaagcaggagcaggggagggaggaggtgccacacaattttaaagaaccagctctcataagaactcactaccatgaggacagtaccgagatcatcgtactaaaccattcaagataaaccaccccccatgatccagtcacctcctaccaggtcacatctccaacactgaggattacaattcaacatgggatttgggtggggacacagatccaaaccatgtcacttatcaaggtctaccttcaaattatagtataaccttttctgtaaaatgtactaacctttcaacaatatacattcattattcctctcctaccctttatcttgttttcatacattttactacctcatatgttatatgtcccacaatatattgctgggtttttttgttttaaatagttaattatccttaaatttttaaatgaggaacaagaactctgttatatttactcacatatttagcatttccaaaatgcttcattcttctgtgtagctcagtttccattaggtatcgtttcccttctttctgaagaacaatgtttaacatttctcatactggtgatctgtttgtgatgacttctttcagctttgatttgtcaaaaaagtatttcacctctatttatgatattttcaatggatatagtaatctaggttgacagctttgtttttcctctcaacactttaaagatgtcattctcttatcttctgacttttatagtttctgatatgtcttgataagcatacctttattcctctttaataggcctattttttaatctacctgaatttaagatttttctctttatcagttattttcagcaatttgattatgatgtatcctggtgctggttttctttatgattatcctgtttgtggcctattgagcttcttagatctggaagtttatgctttccatcacatatgaaaatttttgaaacattattactttatttttctgtgcccaccttctggtgttccaattactcattttttaaaccacttgatattggcctaaacattaatgaagctctatacattttttcatcttctgtctatgcttcatattctgcatagtaatttttaatataattgatcttttcttctgcagtatctaacttgtctgtaatttatataagtgaaattcattaaatatactttatatttcatctttataagttccatttggctctttatattttccatttctctacttatgttgatttttgttttaattacttgaatatattgaatatatttattgtagctatttcaacattcttgtttgtctgctgattccattatttctgttttcaggtctgtttctattaattggttttaattttgatttttgagctatgtttctctgcctcttgacatgtctagtaatttttttactgtatgccaagtagttgattttatgttgctgagtgttagattctgctatatttgtttaaagaggattgatctttgttctaacagacagttaaattacatctgaacccatttgatctatgtggagtttcatttatggtggcttagactagtctttattctagaactaatttattcccactacaaaggtgtgacccttctaatatctcccccaaagaacccacgtattctgtgagtgtttttcactctaatgggaactcaaatgatttctggtcctgtatgttctctgggaattgttcagctcctcaataactttttctaagaagttgtttttgcacactccatggaatttcaccttacccatatataggactcaaagggactcctaaacagattatctagaactttttttttccatagctccctcctgtctgttatatcaccttgcacatcctagttaccaagacctgcccaaactttaatctatgtctcccaccattcagcaataccacaggcgctgtttgaatttcccttccctgcaccaagatctggaagttgcctccaggcagaaagccaagacaatcatagagttatctcttttgtttcctttctctcaggaatcaacagtgttgttacctgttatcccatatatgaagacagttgtttcaggtacattgcccagttattcagttgtttatagagaaatggcaattctagatcctgttatttcctcatggctaaaagcaaagtcctttctcatatctgattgtgtgtcaaatgctatatataaaataactgtagagactacggttgatgttatttgccacagaggatttgccctttctttttttcctcttcttttttcttttttttttttttttttttttgagacagggacagggtcttgctctgttacccaggctggagtgcagtggtgcaatcatagctcactgcaacctcaaactcctgggctcaaggaatcctcccacctcagcctcctgagtagctaaagattacagcacacaccaacaggcctggctgattttttatttttatttttatagagacagggtctcaagatgttacccaggctggtcctgaactccaagctcaagtgatcctcccaccttagtctcccgaagtgttggggttacaggtgtaagccactgagcctatcctttgccctctcctctgttacgcagaaaggaactgagctaggatgagattggaatgaagctttagttagattctgctcacttctattttcaaaaatctcaagggtgaaactgtcagttgtctgtgtaggcatcttcctctagattagtagttctcaaagtatggtctgtggatccccaggggtcctgagatttttttttttttttggtggtcgagggggaagcatgaaataaaaactgtaatatagtaatactaagatattatttgctcttctgtgttgacactagcactaatagtacaaaagcattggaaggtaaaactgttggagacttaacatgaatcaaggcagtggcacccaatgtacatttatagttttcagtgccatatacccacagtaagaaaaaaataccaattttacttaatgtccttgatgaaccagtacaaatggtgaaatttattaacttttgacctgtgagtacatgtcttttttataatctaaattacaaaatgagaagtatatataaagcatttctgccatataccaaaatatagtccttgtctcaaggaaaagagcttgtgtgattcttttgagttgcaagctgaattagctggttttttgttttccatgaaacaccacttttacttgaaagaacaatgaatagacaaattatggtctttcaacttgaatgtttaataggtgtttcctctaaaataaatgcagtaagaaaaataacagtatttgttgccaaaaataaaatttgagctttcaggcagaaattagaattgtggaaaacttgtatcagccactataaacttgacagcttttcaatacctaatgactttttctaatgagatcagtggtgatactaataaatatggtatttttaaatatcataaaataaaacgtcaatgtttggaagagaagcatacctcagtaaaccaacatttccaaatgatcaatgcatggtacaaaattatggacgggtaaaaaaacccactcaaaatacaaaacagaataacacattttaatgtaataaagttcaaaaagtacattgacatggtttcagattccactctgtaactaacctttaagaaactaccacctgtcaaatttggggatcagatcaaaaaagaatattcacaattatctgaaaaagtggttacattgctcctccttttcccaactgcttatctgtgggaggctccattttctcaacttattttaaccaaaacaacacattgcaacaaagtggaagcagaagcagataagaaaattcagctgtctcctattaaaccagacagtaaagtgttacaaaatacaaaacaatcctactccttagtaatatctttttgtttttaaaagtgtaatcctttttccaaaaaatgtttattaatgttcacatgtaatgggtctattattgttttaaaagtaataaatatttaaaattcttacttttaatttctgaatttctgatacagtaaatatcaacagatataagccacaaaagcaaaatatccttgggggtcttcaactatttttaagattggaatggggtcttgaaatcaaaaagtttgagaacctagcaagtctcctaagcaccatgagactataagagattcaacttggcttttctagactggccctcagcctcccatactgccatagcatttagcaaatacctagtggagaaaaataagtctgcgaatttcaggctcccttagatttccatctgtcaaaccagcccatacaactattaaaaggtcatttgacttctcttttcctgcgtgggctcccccacctggaccaaacctgatctagaaacatgtccatacttggaaactgtcctcaggagaaaccaattggccatctcagttcacatgagaaaggggcttccctctctagactttcagtgtatctcctcttttcttccacagctcccctatagctttaaaaataagatttttagaatgtattcatattctacacaggaaatggtctgtcactatctaccacatattatccaagggaagaaatcttttaatccactaaaaaataacaaaagctagcacatataccacctgccaaacaatcttcccagcattgtatgtaatagtaactcatttaattctcaaggcaacataataaggtagataatattactatcctcactaagtcacacagctggctagttagcagtgaagccaggattcaagcccaggcagttgtttcagagtacaggcccttagcctctaacaaggtacctacccttggtcttatctaccacacattttcccccaggaaacagcccattttcagagttgtgactatcacctgaagtcgcaaaatcttgatctccaagtctcacctgtccaactgctggctaaacttcaacctggatgttcagcatattataaaaccaatgcatcttcttcacagtcctgaaacctctttcccaaactgtcaccaattctttagcatccttcccacccttggccaatctgggcaattatgatcctatcttcccctaagtttcagatacatttatgtctataccagtaatccccaaacactgatttccaaccaagtttacaatggtgcatataaaaaagagaaaaatagtaatgtgctattcatttttaaaaacctgtcttttattctgagataattcctactatttactgttagaatgtttttgtttttccttttatgaaaaaatgataatagataatagttcattttatatttttttcttagtgaactaaaacattaacaatactataatgattcccaaagttagctgctctgaaaatttactaacctaggaaatttttatatcagcaatctttttttttccctcaaaaatggcagattagaggctttgttagcatacctcatccatttggaaataacaaaatagtgtgtagagattcatactgtgaacttttatacaagaaggaacacaggagcttaacacaaaagtgaaagaaacttcagatactttgaaaaataagagcgggcagcagcttgcactgcaggtcaagcagaaaactgatgtgaattcccagtatgtgagtggggggagtgtctccacaatacacattcctactggggagccaggcaatccaggtcacaggggagctttctgaccctatcaagtgctgatagtgtcagggagcagtggagagactgtgagaaggagcagcagagggaagtgctccatgcacactcccagaccttggggtcaatagaaggtcatttctggtcctaattaattaggggacacatggatgcctaccaaccagaataggcagcagtcaatgatttggagaatctctggactggcatttgtgatctagtctcaagcggggaggacaccccacagtcagaaccaagaggtgaatgtggtgtgagctccagctgcaggtgcaggagttaggcccccaattccctctttgtgggactggactgggaggagtgtggcctgggggccgcagtttttgtcctgggagtttggcagactggggtggttttgcaacctgaggatgaactgtttgtgacttggctggctgtctcagcttgctgcaagaggtggtctgcaagagaaagtcttgctaggtcaagaccatgggagcaatgcaggtcccactaccacgtgctaagctgtggagctcaagcagtccctttttccccatactggctctctagcatggcagtggttgtcctactgctccctggagtgttgctccaggggcttgaaaacagccttctgacccttatcagggctggtgtttgcacctgccattggagggcctgagcacagacttgcctggcccagctctacccagctctgccctgccccaactgccttagagacagaccataggttatggtaattgcagaggttgcacaaactttgtctccttcccgagcactgtgcaattgtgtcagcagatactataatgcgctgaacttcagaacctgaagacaagtctttacaactaatccatagcccagcccgttgcatgggacatccaagtacttctcctggttaacaaaggtcaagtataaacactactgcaaccatcacagcaggctctcacctgtaagtatcaattactggccaggaggtcaacatgcaaagcccattacagtatctgctgatacaactgtacagtactcaggaaggacacaagctttgtgcaacctttactattaccattacccacacaagcccggctactcaggagaccttgagcctactctccctactggtacattactactacaactggcatttgagaaagctgctgcattaaggctttttataaccaaggaaattatacagtgtctataccagtgaatgcacccaaaagcaaaactagacaaccctactaaacatcatcatagacacaccctcaaaagaaaaaaaagtcctactccaacaaaagtaattcaaaaataaaaagaagcgactgttaccccagatgtgaaggaatcagcataacactgaaagtatgaaaaaacaaggtgctatgagatcctcaaaggagcacagtacatctctagcaatggatcctaacgaaaaagaaatctttgaaatgccaggtaaaaaattaaaaatactgattttaaagaagctcaacaagataaaagagaaatctgaaaaccaatacaaagaaatcagaaaatcaactcaggatatgaacaagaaacacaacttctagaaatgaaaaacttgttcaaggagttacaaaatacagttgaaagcttcaacaacagaatagactaagcaggtgaaagaatttcaaaacttgcagacaggccttttgaactaacccagtcagacaacaattaaaaaaaaaaggaatgaacagctgagcacagtggctcatgcctgtaattcaagcactttgggaggccaaggcaggcaaatcacgaggtcaggagcttgaggccatcctggccaacatggtgaaaccctgtctctattaaaaatacaaaaattaggccgggcgcagtggctcacacctgtaatcctagcactttgggaggcagaggtgggcagacttcctgaggtcaggagttcgagaccagtctggtcaacatgatgaaaccccatctctactaaaaatacaaaaaattagccagctgtggtggtgggtgcccataatcccagctactcaggaggctgaggcaggggaattgcttaaactcaggaggcagaggttgcagtgagccgagattgcgccattacactccagcctggtgacagagcaagactcagtctcaaaaaaaaaacaaaccaacaaacaaacaaaaaaaacaaaaaagaatggacaaagccttcaacaagtatgggactatataaaacaatcaaacgtataaatcatagtgtattagtctgttctcacaataaagatataccagagactgggtaatatatatatacacacacacacacacatatatatacgtatatatatgtatacatatatacgtatatatgtatacatatatatacacacacatatatacatacattttatatatatatatatatataaaaatatatatacatgtgtatatatatgaggtttaatggattcacagttccacatggctagagaggcctcacaatcatggcagaaagcaaaggcatgtcttacatggcagcagacaaacaacatgtacaggggaattgccctttataaaaccatcagatctagatggttttataaaaagcagtttatagaactataaactagaactagaactataaactagaactagaactcactcactatcacgagaatagcatgaaggtaactgtccccatgattcaattatctccccaccaggtccctcccacatttggggattatgggaactacagttcaagatgagatttgggtagagacatagccaaaccatatcattccacccctggctcctcccaaatctcatgtcctcatatttaaaaacacaatcatgcctttccaacagtcccccaaagacttagctcattacagcattaaaccaaaagtcgaagtccaaagtttcatccgagacaaggcaagtcccttccgcctaggagcctataaagtcaaaagcaagttggttacttcctagacacaatgggagtacaggcattgggtaaatactcctgttccaaatgggagaagttggccaaaacaaaggagctacaggccccatgcaagtccgaaatccaacaaggcagtcattaaaccttaaagttccaaaatgacctcctttgactccatgtctcacatccaggtcacgctgatataagaggtaggctcccaccgtcttgggcaactcagcccctgtggctttgcagaggacagcctccctcccagctgctttcatggctggcgctgagtgtctgcagcttttccaggcacatggttcaagttgtcaatggatctaccattctggtgtctagaggatggtgaccctcttctcacagctccattaggcagtgccccagtggggactttgggtggtggctctgaccccacatttcccttcttctgcagcaaatttcttcctggacatccaggtgtttccatacatcctccaaaatctaggcagagattccccaacctcaattcttgttttctgcacacccacaggaccaacaccacatggaagctgccaagacttgcggcctgcaccctctgaagccacagcctgagctgtatcttggccccttttagccatggctggagcggctgggatgcagggcaccatttccaccaagtccagcagctgcacacagcaggggagccctggaccaggctcaagaaaccatttttccctcctaggccatgggactgtgatgggaggggctctccagaaggtctctgatatgtcctggagccattttccccattgttttggcaattagcatttggcttctcattacttatccaaatttctgctatgggcttgaatttctccccagaacatgggattttcttttctacagcatcatcaggctgcaattttttcaaacttttatgctctgcttcctcttgaatgctttgctgcttagaaatttcttccaccagataccctaaatcatctctctcaagttcaaagttccatacatctctagggcagggcaaaatgacaccagtctctttgctaaagcacaacaagagtcaccttcggtccagttcccaacaagttcctcatctccatctgagaccatctcagagtggactttactgtccatagcactatcagcattttggtcaaagctatttgacaagtctctaggaagttccaaaatttcccacaacttcctgtcttcttctgggccctccaagctcttccagtctctgcctgttacccagttctaaagttgtttccatatttttgggtatctttacagcagcccctccttctacccagtaccaattcactgtattagtccgttctcccactgctaataaagacatatctgagactggataatttataaagaaaaatgaggtttaacagactcacagttccacatggctgggaaggactcacaatcacggcagaaagcgaacaaggagtaaaggcacgtcttacatagcagcaggcaagacagcacgtacaggggaactgccatttataaaaccatcagatcttgtgagaactcactcactatcatgagaacagcatggaggtaaccgcccccatgattcaattaccttcccactgggtccctctcatgacatgtggggattatgggaactacagttcaagatgagatttgggtagggacacagccaaaccatattacatagattaatattcctgagggagaggaaaaagaaaaaagtctggaaaacctttttaaagaaataattcatgaaaacttccctattctaacaagagatttagacatccagatataagaggctcaacaaattccaagcaaatacattgcaagaaggacctcacttcaacacagagtcatcagactgtctaaaatcaatgtgaagaagaaaatcctaaaatcagcaagagaaagtatctagtcacttataaagaaaaccccatcagagtaacagcaaacttctgagcagaaaccttacaaggcagaagagattgggattctaattttaaaatgcttaaagaaaaaaaaaaactgtcaactacaaattttgtaccctgcaggaataaatttcataagtgaaggagaaatagtctttcctagacaagcaaatgctgtagcaattcatcgccactagactggtagtataagaaatgctcaaaggagtcctaaacatggaaacgaaaggtgatacttgccatcataaaaacacgtgtaagtatagaactcagaggtcttataaaacaattacaaaaaggaggaagagaaagaaattaaataggaacacaacagaacacaaaaccacaaacagaaaaaaaagagagagaaacaaaggatctacaaagcaactagataacaatcaatatcatgacaggaaaaaaaactcacatatcaatattaaccttgaatgtaaatgcattaaatgctccacttaaaagatacagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagcggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaagatacagaatggtggaatagataaaacaacctgaaccaactatatgctgctgacaaaaattcaccttactagaaatgggtacaatgtaaactttacaggtgatggttataccaaaagcctagactttagcactatgcaatatatccatgtatcaaaactgtacttgtacctcctatattaatacaaaatttttaaaatttaataaaacaaaatcagtaaactactgatctatctcagctttatcaatttatcagaatctgcctttgactttcccacctctcttctattaataatatagtcaggtataagcaatcggtcaggtatcctacccaaacacactcaaatgcaagtaataaaagtaacttttatggctatatcaaaaattataaaatgtattgaaattggttccaaatgttattatttaacttttttagatgatcaaaaaagatacaacttcttactgttttagatccagttaactagccttccttactctacagctcacttacctgagtggtaaggaattaagttaactgtttccaatagctttgtagggaaacctttttatagtctaaatcatggtaagatcatctttaccaagcactttctgacatacaatcttatttaatcacaaactctaaatgtattttcatcaatttttgcttctaccaccaatctgatgataaaaagtatgttttgaatgatagaatatgggagttagatgaaacccaaaatatcatctactccaaactcttcctttcataactgagactagtgatacagcttaaagtcatacagctagttagtgaatgacacagctgagaccagaaagctaactaagcccttcagctatctagctggctatatcaagaaggtcaaattcacaagagaagaaccataagtgagatagaaccaggctggaaatcactatactcttaaagttaagcaggtgaagtgggtagaataacattcataaacagcttcactaatgtttaaaggaagcagaattgctttgggttcacagatatcaaaagtcatgctgacatgcaatctccaggggagattagaaaggaagaacaagaagtcagtgaggagaatgaaccagaatgaatttgctctgctctcctatttagccactgactgggggttggggagtgtagtgcagtcaaaaggttagggttttggtccatcaagagatgaacagataaacaaaatgtggtatatccataagatgcaatattattcagcaatacaaaggaaagaaattctgatatatgctacaacatggatgagccttgaaaacattatggtaagtgaagtaagccagaaataaagaacaaacattgtatgattctacttatatgtggtatatagaacagacaaattcatggagacaaaaatagaatagatgttaccaggtacagggagaggagcaaatgaggagttactgtttctatttgtgatcataaaaaagttctgaaaattaatagtggtgatagttgcaaaacaatgtgaatgtacttaatgccagtgaaccatacatataaacatagttaacatggtgaattttatgttatgtatattttaccacaactttttaaatgcaaaaaaacaaaacagagttttggaggtatgaggaatttgttttctatgccacttaccaacttgttagcaatgggttatttctccttaaaaactctgcttaagaaaaatataaattcaaacactttaccacaggtgacatatttttataattttagaagaattataggaagctccagaaaacagtcctggaggtaacacaaatcctgattgagtagtacttattactagcaggtctctctcttttttgagatggagtctcgctctgttgcccaggctggagtgcagtgccacggtcttggctcactgcaatctctgcctcctgggttcaagcaattctcctgcctcagcctcccaagtaggtgggattacaggtgcctgccaccatgcatggctaatttttgtacttttagcagagatgggctattacccatgttggccaggctgatttcgagctcctgacctcgtgatccgcctgcctaggactcccaaagcgctgggattacaagtgtgagccaccacacccggccagtctttcatttatttatttattcatttattttttaattaattttttgagacagagtctcactctgtcattcaagctggagtgcagtggcatgatcttggctcactgcaacttctgtctcctgggttcaaatgattctcctgcctcagcctctcaagtagctgggattacaaatgtgtgtgccaccatgcccggctaatttttgtatttttagtagagacaaggtttcaccatgttggctaggctggtcttgaacgcctgaccccaagcttcccaaagtgctgggattacaggcttgagccaccacacctggccttactagcagttgttattaaatgattatttaacactcctatacttatttctacaagacatccattgctattcaaaaaaatctaatttatctggagagaaaacaaggactccctttgttgtcccaaggacatgctatagggattggagtcctctgagactgtaactgaatcagctcagcagattactgcatttagcctcccttcctcttaacctggtagtgtcctacccgtctatgccaggggtaacaatctcaaatgcctaaagaagccagagccagacaaggaatataaatgaatgaagcaataggaacaaatctggcaagcaaaaaatgaaagctgtggcaacctggaatgcttctgccacacctacagaagcactgtcaattgatgccatgtgggaatgctattttttcattgttaccatgccttctgaattttcaaaagaggctagaaatttagatttttcaacaaactctaaaagctgagcaaaatgaatcagagaaccctaaatactttacaagccgccagtctgtgctttttgctccatgaacactccaagctacgaaggaaaatgacaggaaacaatacttcctagttattcatatctcattttggatctaaggactccaattccctgagagcaaggcagcaggtggcattcaagtcacgtaaaataaataagtcaaaggcataaactgaaaaggcaattttcttaatatctacttaacatataaaaagttaaaacctgacacttagagtatatgttaaaataacctaccaactttcaaaatgtcaggaactcagatgagtccatggtaactgcagaacactggaagaaaatattaagcagcaagaatataatttttaaaactctctgaagccaccctaaaaatcacatgattcacaacaaacctgttccctatgccatgacatgaaatgtctgttgtatcatcttggatcccatcctcttgatttttataactttggttgatataacagatatggatctgtaattctatatattaatttcccaaattccaatcgaaaatctctgtttgaaactgcctacctacttgattttttttttaattagggaaatattgctggaaaagaggagaaaatattttggaaaaagctgctttcttacagtttgacttagatacagaagtcaagaatagtacaggagtgaagctatttttctctttcccttgtcacaaaaagactagctacttctctccaaaggtgatctatttctggacaaggagagtcagaattcttccttaaacttaacccagttaacgtattcaccatcaatataatctccttctactacaaccaaaacaatatacagcaggatttaactaacattatgtgcttatgtactaggcactgagctaaactcatgtaatcctcactatcctacgaaataggtacttctatctgcaaagtagacacggttcctgccctcagaaggctattttctaatggcagaggcagacattaaacattctcaatgaagaatgtaccactgcatttatgatcacagtgagaaaggagatgaacaaggtgctaccaatgtacgtgaaaggaaaatatgaccttacccggggaggcatctctgtggaaataacattctatacagatcaaaggataagcaagttttaactaggcaaagtctccaggcagagagaagagtatgagaaaaggtcttgtgatggagtttgagttagagacaaaaaaagcaaatgcggccaacacagggagaataaggggaagcatgctgaatgaataggccatccagggctttgccatttacattagaagtctccaagccattcacattaaaagtctccaagagcaatagaaaatgctgaagttagaaaaaggggaagagaattatcagaattatgggcattttaatgcattttttaaattgaaagaacgtaaaagaagaaggtactgtctattgtctcactcccaccctgtcaatgtctatctgattttctccaccccactggtaatcaatcttagtcttacatagtacgcttatcctggtatgaatccacaggtgcatgtgcgcgcagacacacacacacccataaaacactttcctcctttcttacacaaaggatagcatgttatatgtactgtcctctacgctgttttttgtttgtttgtttgtttgtttgttttttgagacagagtctcactctgttacccaggctggagtgcagtggcacaacctcagcccactgcaacctctgcctcccaggttcaggtgattctctgcttcggcctcccaaatagctgggattacaggcacgtgccaccacgtccatctaatgtttgtatttttagtaaagatggggcttcaccatgttggccaggctggtctcaagctcctgacctcaggtgatctgcccgcctcagcctcccaaagtgctgagattacaggcactaattacaggcactaatgcctgggcatctaccctgttttttttcacttagtatatctattctttcttttgtttccaattgcacagcattccacggtttgatgtatctaccatgggttattttgttattacttttttgagacagagtcttatgccgcccaggctggagtgcagtggcatgatctcagctcactgcaacctctgccccctgggtttaagaaattctcctgcctcagcctcccaactatctgagattacaggcacgtgctaccatgcctggctaatttttgtattttttagtagagacagggttttgctatgttggccaggctggtctcaaactcctgacctcaaatgatccgcccacctcggcctcccaaagtgctgggattacaggcgtgagccactgcacccggcctaccatgggttatttaatgagtctcgtggatgagaagaaaaagcctacccaactgctactggattttgctgttacagacaatcttgtaagtgaggttgctgggtcaaatggtaagtgcatttgtacttttgacagacatggttagattctgcactcctaccaacaatgtatgacatcatttatgaaaactggacaaccaaatgagttaccaaacttttgagtttttaccaatgtgacaggtagaaaactgttttactgtagttttaatttgcatttcttttttattttaggtaaggttgcacataccttcacatgtttaagagccatctatacaattggccctccatgtttgtgggttctgcatccatggattcaaccaaccacagatcaaaaatattcagaaaaaaaatagatggttgtgtcagtactgggtatatacagacttttttcttgtcattattccctaaacaatatagttttacaacgatttaaatagcacttaaattgtattaattattataagtaatctggagataatttcaagtacacaggaggatgtgcaaaggttatacacaatactacttcattttatataacggaattgagcatctatggatgttagtattggggggtgggggatttctagaaccaatccctcactgatactgaggaataactgtacttcttcttcttctttttttttttttttttttttttgagacagagttttgctcttgttgcccaagctgcagtgcaatggcatgatcttggctcactgcaacctccgcctcccaggttcaagcgattctcctgcctcagtctcctgagtagctgcgattacaggcacacaccaccacgcccggctaatttttttgtatttttagtagaaacgggggtttcaccatgttagcaggctggtctcgaactcctgacctcaggtgatccacctgcctcagccttccaaagtgctgggattacaggcgtcagccaccgcgcctggcaactgtacttctttttctgtcaaactatctgttcatgtcctttgctcttttttttttttttttttttttttgagacggagtctcactctgtcgcccaggctgcagtgcagtggtgtgatcttggctcactgcaacctccacctccgggttcaagcgattctcctgcctcagcctcccaagtagctgggagtacaggcacccgccaccatgcccagctaatttcttatatttttagtagagacgaggtttcatcatgttggccaggctggtcttgaacttttgacctcaggtgatccacctgcctcggcctcccaaagtgctgggattacaggtgtgaaacactgtgcccagccctttgcccatttttctataatgtttttatgagcatgtgctaactttccttctctccatttatacaactgtcggcaacataagcgtcaattgttttaaaaactgtatttctcttttgactttccttatggtagttttttatcacagagatttttaaaggcaaatttaccaatcttttgacttccagattttgagtcataattttagaaaggctttataattctaaggttataattaaattctcctctggtttcatttttttatatttaaatctctgacccatgtaaaatgtatctgagtatacaacataaaggatctaatgttctctttttccaggtggcttcaaagttgtaccaataccattattagagtccatccttactcccactgatatgagatactgctttttaccatatcctaggttgttatattttctaatctatttctgaattttaatttctgccctattaggctgtctatccatgcaccaaataccttactttaattgaagctttagcttatgttttaatatcaggaaggtcaagtcttcatttgtctttcaagatgtttcagacttcttctctttcaaagtttttcagaatttagtttattacagtttttgtagtattttttattaggatcacttcaatttgtaaattaagtaagaaagaattgacactttatcatgagtctcaatttcccaattaagaacatggtatgagggccaggtgtggtggctcacacctataatcccagcacttttgggagaccaaggtgagaggattgttgaggtcaggagttcagtaccagcctgagcaacatagcaagactctacaaaaaataagaaatttagccaggcattgtggtacatgcctgtagtcccagctacctgggaggctgaggtgggagaatttcttaagctcgggagatcagggctgcagtgagccatgattatgccactgtacttcacctggtgacagagcaatggatgatcttggctcactgcaacctctgtctcctgggttcaaaggattctcctgcctcagcctcccaagtagctgggattacagatgtgtgccaccatgcccggctaatttttgtatttttagtagagacaaggtttcaccatgttggccaggctgatcttgaacgcctgaccccaagtgatccactcacctcagcctcccaaagtgctgggattacaggcgtgatacaggaatgcatagaaaaacaaagaacatggtactttttttatgcattcacgtctacttttgtgttcttcaggaatgtaaagagtggattgaaaagaggataggtaggtgaggttaggctagggaagactgtggcaattgaagaatatgtatgggataaactggagagagaatagagtgaagagagcgattcaacatttaatcacctggataggcctgccacagaggcagaaaatgaattctacaaagttagaaagaaaacaaaaagaaaagtattttttaagaaaaaagaaactgtcaaaagtacaattaagatgaagactaaaataaatacattaggtttagtgatatggaagtcattagtgatcatagtaagatctattttgggagaattatgtggctggaagccaaagtgggacttacattccagttaggccaaatagggctatctggctttaatttgtttctaaaagggtcttcctaaaggtcaaaatgccactgatttcagagtataactgtacagtaattattcctaaaatggagttcaaacacactctcagaaggaggttcttgaataattcacacaaagaatgcacagatccagaaaatactgccaatacaaggaaatatcagaaaccagactaggaagtaacagctagagagccaagggagtggcaaacatgaagtacattttctccaaagcaaactaggctataacttcagaaaaggatttggcttggcattagcccctgcaagtatacatacattcttaagcacagccagagagccagataaaataggtggctgcctaaactggatgccaaaataaggctctagctgctcagaaatacttccttctgcatcttgtcaagatacccttctctccttctctcaatctgaattcaaaatcctaattgtggtttctcttttgagatagtcccaacagaagcatatgggcttccccagcaggaaagtaaaggtattcaaggtatccccagtccttgttaacattcacaaaaaggataacacatagcatttagccacaaggagacagcaagaagggttaggaaacagaggcatcaattaaagtagtgacaatacattgatctgagccaaactggggctgaacatactaaaaggagaatgtcccattggaaattccagaaacctgggactgtgtgaaggtagagaatcacagggaattggggcatggcactcaaggggcataatcatagaatctcaactcaatgagtgaggcttagatgtaatctagttcagaaaattagaaaggtgatattattatatcacaattttaccactcatatttgaacctccacctccgggttcaagctaggaatctccaatggaagtaattaacagagcacatcataggttaaaaaaaatttttttttttattttagttccttcagaattctttaggacagaaagaactcctaagcccacctaagctggtgtgcatgcccaaaccaatttccaatgtggaaaaatagtgaaatagaccaatatctttttacctcccattttaacacaatttggaacaaaaaaaatttttttttgttaatcatagcactaaaatgcagaagttccaggtcccttctactacttaccagctacagattataggcacagacagcattataccaaaagtactagtaaggcctcttctaggtgtaagatccttgttcataaaaaacagatactctcacatcaggattactgtctcctttggttgctaagacaccaagcagaatcagtagattcaactaaaatcactgaaaaagaggtagaggagaaggaaaaaagggtgtctgaaatagagaaggcaattaacaactcatttattgtggctccatctagaaggttggatatatatttaagttgttctacagttttgtatccctacacctacaccttagctctacttcaatgtccacctaaagtcatattcaaaaagatttgcatcaactgggaaaatgtaatgcttccgacttccaaattactctgtggaagtagtgccacaggttgttccttctgctatcagtcttaagtggtggaattatgaaaaggtactgtatcagagaactgcattcacttagtaaaatgtactcccaggtatcgattctctgcaggaggttgtttcagaagaaaggaacaggggttggctagctggtttcttagtttaatttacataccttctttttagaaccagagggaagtaacaggggatattaaaggatgtgatagctattcctgagggcaatgtttgtatttctttatagaattagaattgtgctagttcttaccagggaagcagggaacaaattatgtattagtacattttgccgaaactttattctatttactgttatttggggaaaatgtattttattcctatggtaaaacgacagaactctgttcccaggcatgtgtctaatcctttttttcaaggaaaaaaatttgtaagcacagtattccaacttacagcaggcacgatggggacccatgagccagagaagatgggaaacaaacaggaaagagactcggcacagacatttgagggtaataaatatgatagcaatctagaagatgaacagttcatgttgtttatgattacaggctgattattcctctaagtgcaaaggctatccaataagtcatatccgggttgatttgttagcaaggtactttcaccagataataaattagaatgtaattaaagtgtattctgcctgtttatcattgactaagatagcttactataattctcaattatttgcatgaacacataacatgacagcatggtaagtaaaccttctggcaaagggcaacaaacatcttaggactgtgctaaaattgctagatttcttctccagtcctttaaaaaaactgtttccaattttgataaagtatgtaaatagaacaaattaatctggcacttgctttggtagagtaagtcacagagctagatctagactcacaagtcccgaaacttcttagcttgctagcaatttgctaaaggcagagactaaaccattaaagaaataaaacagaactgggtatttaccacagacctttattaggtagaaaaacttaactgtagagaaaatagaagaactacaaaaaaaaaaagatgtcaacatgtaaatttaaaaattggatttcaaaaagcacttatctgggcgggtgcagtgactcacacctgtattcctagcactttgggaggtggaggcgggtggattgcttgagcccagaagtttgaggccagcctgggcaatacagcgagacccccgtctctatttaatttttataaaaaataaaaatttttttaaagaagcacttacagcatataagacaataatttcactatataatgtctcctaaggattaataagaaacaagaccacaagacatatgtaaacaagacatacaaagataaacaaataaatagaaacataatgttcaaataaattacatgtagctcagggtaacttttttcacctgattagcaaaaatctttctaaaatgataatgaccaatattggcaaagatatagtgatactagtactctcatacatgctgatagtgttacaaattggttagaactcctcaaaaatgcaatctggcagtgaatttaaacactaaaaaatgtttataattttagcttagtacatccacatcatggaatctatctaataaacaaaaatattggccaggtacagtgactcacgcctgtaatcccagcacttggggaggccgaggcagctggatcacttgaggtgaggaatttgagaccagtctagccaacatggtgaaaccccatctctactaaaaatacaaaaaattagctgggcacggtggcgcagcctgtagtcccagctactcaggaggctgaagcaggagaatcgcttgaacccaggaggcagaggttgcagttgagctgagatcatgccattgcactccagcctgggcaaaagagtgagaccctatcttcaaaaaaattaataataatacacacacacacacacacacacacacacacacacacatatatacacctatcacagcttgatcaataataagaatccaaaacaacataaacattcaacagggtaaaggtatgtgtaatacaagacaataaaatatataatcacagatacaacattatacagcaatttaaaatgacagttaagaagattaagtggaaaaggatagaaaatcatatttaccatgattatatttaaataaaaatatgcatattaaaaaagactaggaaggaaaatgtcaaagtgacaatcattgtgttagggtagtatggcaggctgaataattggccctcaaagacatccccatcctcaaccccagaaccagtgcttgttactttatgtgataagaggaactctgcaggtatgattaagttaaagatctcaagatgggaggattatcctggatggacccaacataaccacaggggtgctcaaaagaggaaggcaggagggtcagattgagaggagatgtgaggacagagcaaagagtgatgaggtacaagtcaaaggatgcaggcagcctctagtggttgaaaaaggcaaggaacagatcctctctagaacctccagaaggaacacagctctgcctgcagccttattttagccccataagaccatttcagatttctgacctccagaacacaagttaataaacttgtaatacagttgtgttgtttggttgggtgtggtggctcacgcctgtaatcccagcactttgggaggccaaggcaggtggatcatttgaggtcaggagttcgagaccatcctgggaaacatgatgataccccgcatctgccaaaaatacaaaaaaaattagccgggtgtggtggcaggcacctgtagtcccagctactcgggaggctgaggcaggagaatcgcttgaacctgggaggaggtggctgcagtgagccgagattgcgccactgcactccaacctgggcaacacagcaagactctgtctcaaaacaaacaaacaaacaacaaaataaaaataaaggtgtgttgtttttagccactagcttcgtgatcatttgttacagcagcaataggaaactaatatagatggtaagactgacctttctaaactttctgtaatatttcatatcaattctattgttgcatgctaattttaaaaattagataaaatttaagtctagatgaaaacatattttgcttcagtggttctcaactctagttgtatattagcatcaagtagttagcttaaaaaaaaaaacaaaaagagtacaaatgtcatgccttctcctgtccccagagattttgatttgatttttgtgaggctcaaatatcattttttttaacccacatactaatgtgcagccagcgttgagaaccactgctctagtatagcaactcataaatgacgagtttccctaggccaaagcagaaatggatatcaatctaaaaccacatttgtctcaaaaatgctacaaatgaaaacactcagtgatagtctatattagtttaaatttagcactgagagttgcatcccagtttaactgactttgtcaaaggaagagaaaaaataaaactctttattctacttcttcaatgttttttatttgtggcatttaagacttcagagatatagtgctccaagaaaaaggtccttattaggatctacattcaaattagagcagtacacaagaattgtgtttcctttgcttacctactgacaactgaccttatgataatactactaaaattatgtaagatatttagtctttgaatttttacagtatgttttagaaatggtatagactagccaagagaaataatccatcaaattctctgataatgtgttctttagaatcacattttccctctactgtattttccaggtatcaaacttgtaaacacacaaacacacacacacatacttcagtatgtttgtgagcaaatgtataacttaaagttttcaaatgtgagattctaagctataaactactgacagtcttatgcatcttttggttaacttagcatcacctcatattctttcagcagcaaaatccatatatgaaaagcatcgttatcaaccaagtgtgtccaaagattgatctccatagcaactgtaactctgccacatgtagtgtataaggcatcagagttaacaccacatgcacacaaagtgttggtattatgtagtccagactggttgctgtagaaacctaaaccgaagtccctgacaacagtggataaaatgaaaacaacaacagaatggtccttaagaacttacctatctactcttctgctttcaagcaaagccatcctaaatgctctattgatattatttatacttaaaactgatagcactaaaggaaaataattttaaatgatgttatatctttaggaatcacttcctattccataaaaaattctccttcccaccctctgctcaactggatgttcagaagctcactccaataaagtaccgtcaccttcttctagcctcagccagaaccagtcccacacagacaagctggagaggtgctagccttttgctgcgactaccacaactatgatagatacagacaagcttattctaaaacaagtttgaaaaagaagaaaagtaggaagaatcactctgccttatattgtctcactacatcgctatcataatcaagacagtatagtattggcagaagaaaagacaaatagaccaatggaacagagaatccagaagtggataaatacaaatacaccaactgatttttcacaaaggtacaaaagtagttcaatggagggaaaatagtcttttcaacaaatcatgctggaacaactggacatccatgggcaaaaataaaaaataaaatagaagcttgacttaaaacgcacaccgcatacaaagatcaatgcaaaaaggatcacggatttatgtaaaatgtgaaccacagaactataaaacttttagaagagaacataggagaacatctttgggacctagggctaggaaaagagttctcagacatcacatcaaaaacccaatctataaaagaaaaaaaaaaaaccagtaactggatgtcatcaaaatttaaaacttttactctgcaaaggactccattaacaagataaaaagatgagccacatactagaagaaaatatttgcaaattttatatccaaaggacttctatccagaatatgtaaagaattctctaaactccgcagtaaggaaacaaacagtctatttgaaaataggcaaaaagacttgagtattcatcttaccaatgaggatgtaagtatggcaaatcagcacatgaaaaaacgttcgacatcattaggcattaaggaaattaaagctaagatgagatattactacacatctattagaatggctaaaataaaaaatactgacaataccaaatgctaacaaaggatatggagaaactagatttctcataccttgccagtggaaatgtaaaatagtacagctactctggaaaacaatttggcaatttcttatgaaattgaacatacacttaccatacaacccaacaatcacactcccaagcttttatcttaaagaaacaaaaacatgttcacataatcacctatacatgaatgttcagagcagctttatttgtaacagcccaaactagaaacaacccaaatgtttatggtaaatggatatataaactatggtacattcatacaatgagatattaattagcagtaaaagggaacaaactactggcatacacaacttaggtggatcacaaggacattacgctgagtgaaaactgtcaatctcaaaaggttacgtactatatgactccatttctataacatttcaaaagacaaaaacataaaaatgaacagatcaggcagtgctcaaggttaggaaaggaggaaaattcctggtgctgcactttgtagtctcaaagtgcaacaccaggaattttcttcatagcgatggaacagtcctatatcttgatgatggtagttacaaaaatctatatacgtgataaaatttcacagaacacacacacacacacacacacacacacaaacgaatgcatgtaaaaacgagtgaaagccaaataaggtttgtagtttagttggcagtactgtaccaatgccaatttcctggtttaaataatgttctatacttatgcaagatgttaccacggggaaagctggatgatggctaaaaggacctctctgtacaatttttataacttcctgtaagtcagtaattatttcaaaataaaaaggttaaaaaaaacttgtcagcaaaaacctataaaattttaaaagtaaaaaaaaaaaaaaaacttaaaacatttgacaaaaagacccttaatatatgaagagctcttctatgtcaataggagatagtgcaaataaaaataaggaaagaatataactaggcaactcaacaaagaaataaaattggccaaccacataacaaaaaagactcaatctcattagtattcaaatactaatattagtattaatattcaacatacaagaagacttttataacatctctcaagttggcaaaaattatcaatatccaaggttagtaagaacaaggaaaaacaggcactcccatataccatggacagaaattaatgtatgaaaatatttccaatagaagatattcatactcttaatcccaaaaagtcaatatttaggaaggtatcctaaggaaataatcaaacaagtgtgcaatgacatacatgcaaattccatcacagtactatctataatagtgaagaattcaggagaaaaacatttaaaaaaaagaggataattaactgtattatggaatattcattataatgaaatatcacgtagttgttaaaattatgtttattaattttaaaagcaattctctatatactgttgagagagaaaagtaacaaaaatatacacatgtgataaacctatttttatggccatgcaggctatacaccaaaatattaacactaggtatctctgagtaattaagactagggtaacttttcgttatatatttctgtattgtccgacaggagcatgttttatacaaaaataaaattaattttcattttttaaattaaacaatacatactaagctaatgagcgttcttttaactggagatttcatatattacgatgctaaaagcactacataattttttttacttccatagaaaaaataaaactaccctgcctgatatagtaacatctgctttttctttatgactcctccaggttcctgaaaagatattcatttttagtttaaaaacaaacaaaaaaagcctgaccagggtggctttaaagaaaaaaatccatgcaacccaaggactatgtatgcttgctcatcatgaagttgataatctctgcatctctgttatatctagttgtaaatggcaatgagtattgttttaggtattagtaaactgttaatttattaataacatattgacaagtgtactctccatttgtcatagaagaaagctggacagcaaaaagggaaaagagaataaaatgacaagaatgataataatatcttccttaatgtgatcttgggaaaaaaagaatttcatttctgaggataaggaaggaggacagcatataggaaataatttcctttttacattggtaacttgtatcaatatcagaatctctgaaagcttatttgatagtctgtggtaagtaaggttttattgttcagttggaaaataaagtttctccagcagagacacatggcttctttgtctgttatttccctcagttaaatacttgaaatgtccaagtttaataataaaatattgttgctttcatagtgaatttcctggattatatcactctcccgaagcccttccagcatttaaagaagttttttgtttttgttttacagacctgaattaagaggacttacaatatgctgaaatcatcaagaagctttcttaggctcattaagttaaaattctcccacatgattaactgctgattttgactcaaaagtaacataatactaccactcctcttcctgatttccacacttggcattccaggtaaaaggcagagcagaaacaacttcttcctattttccatctatacaattctacccatttccagcagcttcttaaaatttttcttcttccataaagcctttggtttagccagcccacagtgttctaccctgaagtcctgtagcacttagctaaacacttcatttagcaattactaacaattatgattatttttatcttgcatctttttttttttttttttttttttgggacagggtctcactctgtcacccaggctggattgcagtggtgcaatcacggctcactgcagccttgacctcctgggcccaagtgatcctcccatgacagcatctcaagtaactgggaccataggcgagcattaccacatccggctaatttctttaattttttatttttatagagataggatctccctatgttgcccaggctggtatcaaactcctgggctcaagtgatcctcccacctcagcctcccaaagtgctggtattcaggcataagccaccacactggaccttgtatcattaaactgcatcattatttgcatctagtttccccaagttctcttgcaggaaccttttttacctcaacatatcccttattgtgctttaatacacagtagtgagtcaataaacatttgttgatcaactataacacaagtaaacctttcagttccactcttatttgatactaatttttttttcaacacttagctattatttctcctacctatcctttgtcttacttacaaggacaaaactacaaaggagaggctgaagatacaggctgtgtaaggcattgcattctctttgtcttcctgcagcaaaaattatttaaaatgtgaaaagagaataaaatgaattgtatacctttggtatatgtctttcaaagtgaaacgaccatcatttaacaagaaattagagacctcattggagaatatgctaagggaaaatccaagggaataatactcatggattaatgaactgattccttctcaaaggatatgaacaactccatcagtctttgatatggtttggctgtgtccccacccaaatttcatcttgaattgtaattcccacaattcccatgtgccgtgggaggaacccagtgggaggtgattgaatcatgggggtgggtctttcctgcacagttcttgtgatagtgaatgaatctcacgagatctgatggttttaaaaacgggagtttccttgtacaagatctctttctttgcctgccaccatccatgtacgatgtgccttgctcctcattgccttccaccatgattgtgagtcctccccagccatgtggaactgtaagtccattaaacctctttttcttcccagtcttgggtatgttttatcagcagcataaaaacagacatacagtaaattggtaccagtagagtggagcattgctgaatgtatacccaaaaatgtgaaagtaactttggaactgggtaacaggcagaggttggaagtttggagggctcagaagaagacaggaaaatgtgagaaagtttggaacttcctagagacttgttgaatggctttgacaaaaatgctgacagtgatatgaacaataagatccaggctgaggtggtctcagatggagatgaggaacttgttgggaaccggagcaaaggtaattcttgttatgttttagcaaagagactagagacttgtggaactgtgaactagagagagatgatttagggtatcttgtagaagaaatttataagcagcaaagcattcaagggatgacttgggtgctgttaaacggattcagttttaaaagggaaactgggcataaaagtttggaaaatttgcagcctgacaatgcaattgaaaagaaaatcccattttcctcacacctgtaatcccagcactttgggaggccgaggtgggtggatcacgaggtcaggaaatcgagaccatcctggctaacatggtgaaaccctgtctctactaaaaatacaaaaaattagctgggcgtggtggcaggcacctgtagtcccagctactcgggaggctgaggcaggagaatggcgtgagcctgggaggtggagcttgcagtgagccgagattgcgccactgcactccagcctgggcgacagagcgagacttcgtctcgaaaaaaaaaaaaaaagaaaatcccattttctggggagaaattcaagctgcagaaatttgcacatgtaacaaggagccaaatgttaatcaccaagacaatgggaaaaatgtctccaggacatgtcagagacctttgcagcagcccctcccatcacaggcctggaggtttaggaggaaaaaatgattttatggaccaggcccagggtccctccgctgtgtagtctagggacttggtcccctgcatcccagctgctccagccatggctgaaaggggccaacataaagcttgagctgtggcttcagagggtgcaagccccaagttttggcagcttccacacggtgttgagcctttgagtgtatagaagtcaagaaccggggtttgggaacgtctgcctagatttcagaggatgtatggaaatgcctggatgcctaggcagaagtttgctgcaggggcggagccctcatggagaacctctggtagggcactgcagaagggaaatgtagggttggagcctccacaaaaagtccctactggggcaccgtttagtggagctgtgagaagagggccaccattctccagaccccagaacggtagatccactgacagcttgtaccgtgtgcccagaaaagctgcagccactcaacaccagcccatgaaagcagccaagagggtggctgtaccctgcaaagccacaggggcagagctgcccaagaccatgggagcccaccctttgcatcagcgtgacctgaatgcaagacatggagtcaaaggagattattttggagttttacgatatgactgccctgcttgattttggacttgcatgaggcctgtagcccctttgttttggccaatttctcccatttgaaacagctgtacttacccaatgcctgtacccccattgtatctgggaagtaactttcttttgattttacaggttcatagatggaagtgacttaagatgagttactggactgtgggcttttgagttaatgctgaaatgagttaagactttgtgggactgctggaaaggcataattggttttgaaatgtgaggacatgagatttaggagggaccaggggcggaatgatatggtttggctgtgtctccaccctaatctcatcttgaattctagctcccataattcccatgtgttgtgggaggaacccaatgagaggtgattgaattatggggatgggtctttcctgtgctgttcttgtgacagtgaatgagtctcacgagatctgatgttttaaaaacgggagtttacctgcacaatctctttttgcctgctgccatccatgtaggctatccacaaaccattttttgtgacttgctcctccctgcctaacgccatgatcatgaggcctccccagtcatgtggaactgtaagtccattacatctttttttcttcccagtctcgggtatgtctttatcagcagcatgaaaattgactaatagagtcttgtccctgatacttccaaaatctgcactcatgatttgagagagcctttatgaaatcaaacatatttttaccaatcatgaattctatctatctaaaaggacatttaagtgccagcaaagagttttataattagaaatccattcttttaagaatagctatattacctaaataattccagatattttgttttggtttttggttaaggggtgggagcaggtgggcagaaaccaaaatgagaactctccctattgtttgtcattccatcctaaatgagccctttcttatatttccagaggtttcttatatttttggaggttccagaatttaagtttatgacactcatttgtaatgcatatgagtatttagattggattgttactttaaaaaaaatggtttgtagatagcctacgtctacattatttctacaaatcccaaccatatcaaactggagttgcttccagcatttataatgaatttaccaacaatatgaggccctatttagagacagctgtttctgagagaggaacaaattttggattgacaaatttcacattttttacagaggttgtgcaccagctgattagaatttgttctgaaattctatctatatctataatgtttaaaactaatatattttcatagtgtatataagatacagtcaaaattttctgaactattccaattactcactagtacactgcagagactcataaggaattttatattgtccttcactctgtctttaaggtgcaagtcaatcccatggaagatttcaaaataaaaggatgcaacagcatcttgtagtaatccattgctaacaagtggtatagcttcaaaaagcttccccacttaattttaatcagcacttgctacaatttaagtgtattcttttgtgctctgtttttagaaaaagttgatcactatcttcaaccatgatgttctatgctttgaagaatgatacacaagatgaatgccgtgactaaggcaaaggtcaggacagggcaaaactctctggttaggcaaaattttattccattccttcaattctataagtacttattgaaggctttctgtatcaagtatatgctgggcaacagaaacataaaagagaaaatcagaccagacgcagtggctcatacctgtaatcccagcactttgggaagctgaggcaggaagatcacttgaagccaggagatcaagaccatccttggcaatatagtgaaactcccccatctttacaaaaagaaatttttttttaattatctgggtatagtagtgtacacctatagtcccagctactccagaggctgaggtgggagtattgcttgagctgaggagtctgaggctgttgtgagctgtgactacgctacagcactccaacctgggcaacagagcaagattcctgtcattcattcattcataattaaataaatagaaaatcatctctttcaaaaagttcacagtcatgggaacacttatacctaaattagaggtccaggccagttcatccatgaagcagcaactataactgaagcacgccaaattgtggaatggagaacatatgcccagtctaaaggatgcagccactacctgacaccagcactcccatgctctgggagaatgcaaactcagtggtgtcacagcttctgattttctgagaagacagaaactttgaggaatgaacatttaacctagagaaatcagggaatgcttagcaaaagagctaacatttgaatcgagtcctataaaggttacgcagagtgtactaggtgtgaatgcagatgccttatttcctgtggctacagcttagggtggaaagtggggagtggcaagataagcaactagagaggaaagaagccatgcacaagctaaactctatgcacagaacacaagaacttgttgaagaagttactctataatacaacatacaagagcagaatttatctgtctgcagaaaactctaccaaactcccatacagtgagatttcaaggtttggtagacatacaaagaggcaggtatcttgcttttagtccataaagctagactggacactactgtatctaaacactctttggcctcgaactattgagacatctaaatgcctgtatggttccagtagcagcagtgggtacataaacacatagcggccatgaagaagaatatactaaacctagggtgggcgcggtggctcacacctgtaatctctgcacgctgggaggccaaggcagccagatcatctgaggtcgggagtttgagaccagcctgaccaacatggagaaaccctgtctctactaaaaatacaaaattagctgggcgtggtggtgcatgcctgtaatcccagctacttcggaggctgaggcaggagaatcacttgaaatcgggaggcggaggttgcagtgagccaagatcgcgccattgcactccagcctgggcaacaagagcaaaacttagtctcaaaaaaaaaaaaaaaaaatatatatatatatatatatatatatatatatatatacaccaaacccagaaagaaagattttgggagatctgtcatccccaaatgtctcccctttactcttgacaagggtaataccttattcattgctaaaattacttagcatatacaagacctcttgacatatattattctcacccacctaagacaccttcagctccctattttctattttgtgggggtttataactcacacatccactgtagccaattgtattcatattttgcactctttttttgtatattaaaccactttaacttcaaaagttctaaaacctaggccgggcacagtggctcacgcctgtaatcccaacactttgggaggccaaggtgggtggaccactcaaagccaggaggtcaagactagcctggcgaacacgacaacaccctgtctctactaaaaatacaaaaagtagccaggcgtggtggcgtgcatctataatctcagctactcagaaggctgaggcacaataatcactcgaacccgggaggtagaggttgcagtgggccaagattgtgccactgcactccagcctgggtgacacagcaagattctatctcaaaaaaaataaaaataaaatttaaaaaggaccgggcatggtggctcacatctgtaatcccagcactttgggtggccaaagcaagtggatcacctgaggtcaggagttccagaccagcctggccacatggtgaaaccccatctctactaaaaatacaaaaattagccaagcgtggtagtgggtgcctgtaatcccagctactcaggaggctgaggttggagaattgcttgaacctgggaggcggaggttgcggtgagccaagactgcaccactgcactccagcctgggagacaagagagaaactccgtctcagaaaaaaaaaaagaaaaaagttctaaaatctaattcagggccacatgttaaccagcaccagcaatttcttcatcttcctaatcttcctaacccattagtcaatcttattttattgtaattcaaaaaaattaatcgatattttgctccagaaaggatgattagttttgccaaggaaatttgctattctccaggtaggaaggaggaaagaaaatcacgttgggttctgtcacctaagcctttcattcagtgagcctcacaacaagataggtattattattccccttttcaccaatgggaaaactgaagttctgagtagttaacttgctcaaatagcaggtagtaaatgactgatgtctgggctaaagccagacctctttggaagacacagcttctaaaactaacttcttcccactattccacatagctttaactgtcaccctttttcttttccttttttcttgagacagggtctcactctgctgcctaggctggagtgcagtagcgcaatcatggctcactacagcctccacttcccaggcttaagttatcctcccacctcagcctcctgagttgggactacaggtgcatgccaccatgcccggctaatttttgtatttttagtagagacaaggtcttgccacattgcccaggctgatcttgaactctgggctcatgcgaacctgctgctttggaccctcaaagtgctgggattacaggcgtgagccactacacccagccacccgttattatttctaataacaatcataatactgcacttctaccttatatttgtacagtacagcatacctttcaaatcactttcatctataatatttttgtgggttcctaaaactatttttcaagaaaacttgggcaaagaaaaaaaaagatgactagcctaagatcacagagaaatgattactgagtacaaataatagttaataacagtagctatatttattgaacagttaatctaaacattttacaatctgttgtctcatgtaatcctcattacaatcctgtgagacagcaatgacaacaatatgacctcttttacagatgagataacaaggcttaaggaattctgtagttcacatagctaggaaatggcagtcttggaattaaaattcaggtactagtaggctcacaaatctattttcttatctacagcatcatacagaactgcttccctaaactgcagtgctctttatagaatattatgcatttactataattaagttaaactaaaattagttagaattgtgaactgaaattgctatcagtctgatttccaaacctactactgaatgaaagtggtggaagaagcaaacaggtggcagaataatatctagcaggaatttaaaagaaatttttcactgggtaatcaacacatagataatcaaaaacacaatataatttggggggaaagtaaaccatcaacatctcaggattatcctctttggatcaagagacattaccctgatcatttaacaaatgagcccactattcaaacatacattcaaaagcaaaaacattctatttttcattttatttttagttgacacataatttatgggatattgatgcatgatatttctcaatacatgcatacaatgtgcaatgatcaagtcagtgtaattagcataaccatcaccttaagcatttctttgggtagtgaacattcaaaatcctctctttggccaggtacggtggctcatgcctgtgatccaagcactttgggaggccaaggcaggcggatcacttgaggccaggagtttgagaccagcctagccaacaaaatacagaaatacaaaaattagccaggcgtggtggtgcacgcctgtggctgaggcatgacaatcgcttgaacccaggaggtggaggttgcagtgagccaagattgtgtcattgcactccagcctgggcgactgagggagacactgtctcaaaaacaaaaacaaaaacaaacaaaaaaaatcctctcttctagctttttgaaaatattcactaaattactgttaaccatattcaccctacaatgccacagacactagaacttattcttcccatctagttgtaactttgtatctgttaaccaatctctccctatccttccctcccctctacctttccctaccaccccaataaccacaattctaattctttaagctcaactttttccttagctcccacatataagtgggacatgtggtatgtatctttctgttctgacttatttcacaacataatgtcctccaggaaaaaaatttttttttaactcatcttatgaaatagtaaaaatcatccaggatggaaaagctccaccccagttttttcctacgttgaccgggtatactcatattcgtaagtatttttaaagttatgttaaaatatccatactacccaaaagcaacctacagattcaatgcaacattcttcacagaaacagaaaaaaaaaaaccctaaaatttatatggaaccacaaaagacccaaatagccaaggccatcctgaccaaaaggacaaaacagaggaatcacattactggcttcaaattatactacagagttattgtaaccaaaacagcatggtactggcataaaaacagacacattaaccaatggaacagaatagagaacccagaaataaattcatacatctacagtgaactcactgttcaacaaaggtgccaagaacatgcattggggaaaggacagtctcttcaataagtagtgctgggaaaactggatatccatatgcaaaagaatgaaaccagacctttatctctcactatacacaaaaatcaaattaaaatggattaaagacttaaatctaagatttcaaactatgaaactactaaaagaaaatattgggcatactctccaggacacttgcctgggcaaagattacttgaataatgtcccaaaaagcacaggcaaccaaagcaaaaatggacaaatgggatcacatcaaattaaaaagcttttgcaaagaaaaggaaacagtcaacaaagtgaaaagacaacccacagaatgggagaaaatatttgcaaactctatccatctggcaaaggattaataacaagaatatacaaggggctcaaacaacttgaagggaaaaataatcgaataatttgatcttaaagtgggcaaaagaagacattcaaacggcaaacaggtatatgaaaaggtgctcaacatcattgatcatcagagaaataaatgcaaatcaaaactacaacgagatatcatctcaccccagttaaaatggctttcatcaaaagataagcaataatgaatgctagtgagggtatagtgaaaagaggactctcatacacgactagtgggcatgtaaattagtacaaccattatggaaaacagtacgcaagttcctcaaaaactgaaaatagagataacttgtgatccagcaatccccctgctgggtatatgcccaaaagaaaggaaatcagtatactgaagagatagctatactcccatgtttactgcagcactgttcacaatagccaagatgtggaagcaacctaagtgtccatgaacagatgagtgcataaagcaaatgtggtacatatacacaatggagtatttattcagtcagaaaataaaatgagatcctgtcatttgcaacaacataaatggaactggaggacattaagtgaaataaaccaggccagaaagacaaacttcacatattcttactcatttgtgggaggtaaaaattaaaacaattgaacttatggaaacagagtagaatgatagttaccagaggctgggaagcatagtggcaggtgggtggtagggatggttaatgagtacaaaaatatcgttaaaatgaataaaatctagtatttgatagcacaacagtgtgactacatttaacaattatttactgtacattttaaaataattaaaagagtattactagaatgtttgtatcacaaagaaataacaaatgcttgaggtaacacataccccatttaccctgatgtgattactaggcattgtatgcgtgtatcaaaatacctccatatatatacgtgtgtgtgtgtatatatatacatatatacctccatttatactccataaatatacacacttactatgtactcataaaaattttttttaaagctcaacagtaaaagacaaacaaaaaatcagtttgattagggctgggcacagtgagtcatgtctgtaatctcagtactatgagaggccaaggcaggaggattggttgagcccaggagtttaagaccagcctgggcaacacagcaagatctcatctcttaaaaaaaaattaatctattagcccagtgtggtgttacacatctgtagtcctagctacacgggaggctgaggtgggaggatcacttgagaacaggagttcaatactgcagtgagctatgatcatgccaccatactgcagcctaggtggcagagcaacatactgcctcaaaacacacacacacacacacacacacacacacacacacacacacacacacacgattaaaatgacctcctttttgtgtactcataaaattgtaccatgcatactccattgtcatatagtcacacttgatttgaatcatggtcactacagaataaaaagtatgtgagaaaataaatattttaaaataatcaaaaatgcttttagcaaaagctttatatatactagagtagtagtcctgtgaaactaaatgacattccttttaaaaacacagtggcctaaaagacatagcctaaagttagagagagatgttaaagaaggtagatttgtgaaggtattattattctgaagataaatctcatttatttgtaatatcaacattttaacagacagaaatctcctgtcataaagcccctgtaattattaaacactgtcaagagctcgatcatgcaaattatcactgtttcaaaaattcaaaacatgactgctaagtttttagagtattcattagacctatctctagcatcacaatactggaaataaaatctttttaatttgctaaaaaaaatctttgaagcaaatgaaataatattccaaggagactccaggagaataattttttaaagctattttaaaacatttgttgaaacgaagttacagaacacaaaaattgcgaaaaaaaaatgaaaggttttcaagagcctttggtgagtcacaggaagaaaagcaaatccagctgcactccataaactaaagatttgtatttagaacttccaaaaaatattaaatcagaaacaactatctgatgtgttaactatgtgcccatttttaaaacctactctctagtatagctacttttgggaaaacattcattaaactcttcgtcaaaccacaaacacagatggatttttttggtaactaatgggcctctaaggtgtttttagaaaagggagacaaatcttggccctagagaataaagaagggacaattacagaatacaggattgatgaaaagcagttggcaatacagtagtaatgagcaacatgagaagagaaattatctgaatccaaattattatctaaacaaaaggaattattatagtacttaaaaacctataaccaatgtatcctcattcattgggctcaaaatgaagaacacagaccagttagaattcttcagccttaaataatatatgtaccctttttaaaggtaaaaattcagttactgagtactgccttaaataatttttattaaaatattatttaaatatgtacacatgtaaaagtgataaactctatttggttatacttcttatgtaactaaaaggagagatttgttaaaggatacaaaatttcagttgggaggagtaagttctagtgttctttatcactgtaggatgactatagttaacaataatgtattacatagtttcaaatagctaggagggtaagaacgttcccaacacaaagaagtgatgaatgtttgaaatgacagacatgctaattaccctgatctgatcatcatacattatatgtatcaaaacatcactatgtaccccatgaatatgtacagttattatttgtcaattaaaaaaataaagtacaaattgaaaacaaaatttattcaaattggcattaatttactacgacagatgatggtacttgactgatactaaattgctattcccaatatgaaatgggtgctgactgcctcagtgtgggttttttttttctttcttttgagacacagtcttgctctgtcactcaggctggaggagtgcagtggcatgctcatagctcactgcacccttcaactcctggcctcgagccattctcccacctcagcctcctgagcagttgagattacaggtgtgtgccatcgcactggtaattctttgaaataagggaagactatcatgaaaatgcattctctcaccccttttctctattcaaattacagttgtgaggctgggtgcagcggctcacacctgtaatcccagcacttttggaggccaaggtgggcagatcacttgaggccaggagtctaagaccagcagcctggccaacatggcgaaaccctgtctttactaaaaatacaaaaattaaccaggcaaggtggcgcacacctatagtcccagctactcaggaggctgaggtacaagaattgcttgagcctgagaggcagaggctatagtgagccaagatcgcaccactgcactccagcctaggagacagagtgagaccctgtctccaaaaaaaaaaaaaaaaaaaaaaaaaatttacagtcgtgccttgttatacatgggggattggttctaggacctcctcatttccacatataccaaaatccatgcatactcaagacccaaaatcagccctgtgggagcctgtgtattatgaaaaattggcctccctgcacacgagcttcacattcccctatgccccacctctggttgaaaaaaatctgcgtataagtagatagatctgcacagttctaacccattttgttcaaaggtcaactgtatatgaaattgttattcatgtaacatactgctcttatatctcctgattgaggccagaagattctttcactctcgacacaggaaacaggttggtgaaaagcacatgacaatcattactaatcactttactggctctagtttctagggctaaggatttctgtgagaaggactgctactgaaatggactccttgaactcagaaagcaatgagaggcacccagggaaaggtcgcatccaggtggtagtagttaactgacagaaacgaagtgggcatggtgatcctaacaggcagcaaggtggatatggaatattaggtcatctcaaactttgttgtgataggcagaaatccctgtctatatttaattagactcaataactcaaatcaacaggcaacccacttagatctgtttttattttttatttttattttttgagatggagtctcgctctgtcacccaggctggagtgcaatggcatgatctcagtttaccacaacttccacccccagggttcaagtgattctcctgcttcagcctcccaagtagctggaattacaagcatgcaccaccacaccggctaattttaatttttttctttgtatttttagtacaaagtttcgcatgttggccaggctggtctcgaactcttgatctgaagcaatctacgcgcctcggcctcccaaagtgctgggactacaggtgtgagccaccatgcccggcctgttttgatttaaataaccaaaaatgaacaaataactccaggtctagtgaacttgtctgagccactacagtagagagtcaggaactctcacccaaattcgagacccacggttccttgaatgaaggggaggccaaatcccttttggaaggttttatttccccccattggatctctggccatttacccaggtaatcaagagctggcaaaagggaaataccaaaacctctccaggattattacatactggctttgagctaacattaattcttaggaattaagaataccacaggttcatcagttggattgacaatttatgaggctcatgtataggagatgaagttctaattcaacctcttctcacaacagtcatcatgacaaagcccaagcacacctagttttcagatgttaccaaatactgcccacaatgactccctggttcagaaggaaggactattatggtaagaggtatgaagtggaagatgatcaaattccctttccttatgaaaattattgcatttctaaggggtgagttttctaaaatttataaaggaatagtgaaatgttattatgagacaaagacatactgcaagcaggcatactgccctcctccctccactttcttcctgtacagagaattgaaaagatgtgtccacctaaaatgatgttgtatttaatctggaaaagctgcaatgaatacaggtattgaaacaaggccatggcaatttcagcaagcaactgaagtaatgatttctttctgaaaaacagctcctggcttgctactaggatccagtgaaaacagaatagaacattaagtgaccatgcaacctagctgtccatcatgagttgttattggatgcatttaactctaaattccagcaagcccaaaatgagctgtgaaggcacaattaaattgcatatcagatcacttacattccttacaaccatattcctgctacatgccacctctccctcaaactacacctatggcttcatgagaagtgccctatgaccagcaagcttgcagaggggaaaatgcctctccctggttaaagaaagacctgagcattatgttacagctgcaagtgtaccactgttgcataacaactccattcaggggtgatcctgagaatcagctgagaggagaaagcctccttgtgagaagcacttacagtggtacgtatcattgttcactttacttgaaaatatgtggcctgaggtcagtatctacatggtaatttctggcatgtccaatagactggctgaataagcaggactggggaggagcatatttggatgactagtgacaaggtagtttgggaaaggaatatttagatacatttttgggaatgggaccagcacctgagaatatctgtgctccatgtgactgctcagcaaaattaccaccaagaagagagtactaataagtatatggacaaggtgactgttactgaaagagtgagccattttccttgcctagtcaattcagtacttggctaaatgttagtgttttgacagggacagtggctatacatgtgctcaacaacagggatttcctcccaccaaggctgagctggtggtctcactgctaagtgtccctatatggtacactcctccagttgagccatctacctcataagggatggactccagtgacccttttcatcctagagaggttagtaatttgtccttttcagaagagatatttattctgtatttggatgtgatttacctgtcatgttgctaccaacactaccatctgtggacttacctgtgtgccagtgtgatattccacttagtgccactgatgaataaaatcacttcccaacaaaagtgaggcaactggctggtaaccaagggcttctttgatcttaacatgtactctttgcatctttcagaagcagcaggctcacacaatggtgaaatagcctatgacaacatagacaaggttccagctaggatctattgctatagaacacagcttatgagccaaaccagcacttttccaactgggtactggacatggcacttctcacaactccagctaatgacctctcaaaattgtttccttcctctaagacagggagctactaaaggttttgtgcccagggaaagaatgcttccaccaggagatataaaaatggtgcctttgagctggaagctgagattgctacctggctcatcatgccagaaaaagcaaatgagaggcttaaatagagggatatatccgctacaaagagagtatctgaatactgtatacaggaggaagagaatgagtacaggtagaatgtaagaaatgctctggagtgcataataataaactataatgaaagactatttcatgtctatctaagctgggccaccaatggcttaggatgaagaaggtgtaacaacccatcaggcaaaggaccccacccagctgaagttatggtcataatctaaattctttatttggtattagtgattgtgacatgaaaatcaaagtaacattttaagcagtaagaagtgtattctttctcatgtaaaaagaagtctggaaatgggcaatacaaaactgtgttggaaattccacaaggctattatgttctttcttactctccagcccaccatccataaaatgtgtcactcaaaaatggcttctagagctccagccactacatcagcactcaaagcagcaagataaaagaagggagaatgaagggtagactcctctctttgaggaggctttctagaaattcaaatgcttctaccaacatttcttttggccagaaattagtcacacagtcacacccagcagtaagagaggctaagaaatgtaatctcttatacctgaataaattcagggttctctcaccaaagtggaaggggaagatgaaaattgagaaaggctgccgccagtctctgccatagcgtgtccacggttttttggtgtttcctctacctcattatttcctctgcactacatataagtgtgatggtagtggataaatttaccatttagcccacaggttgaagaatgtaagaattaggtcacaaaattagaagactgaacacaactcagaggtcctagacatgacaataagttatcttttttgtggaggtggtcagaatgactaatttcctcatttaaggtgggaattcttttaaattatctatacagtaagaaagggggcagaaggcagtaaattcaaggacagggtgccctgctcagaatccattccccttttggcctgtaacacatttcacttttcaattagggaaattcttttcccttattctgtgaggtctaagcaggcatgaaatacagtagcttactccccagctgaccacaggggtggccaacactcaagcaggctcaaacctagtacaccattcacccatgaaggaaatgatctatttggcaataaagaccaaacagaccccctctcacaggactttgaatcttgagcagccatccaaggataaaaggcagcctgagccaaaacttcctgacagcagtgctgtagtctagagaaactgtctgtaaattcctgctactgactgccctagagcgtccccagttctcattcttcctaaggcctgattagctcctccttgcctaagtaatccaaaatcaatttcttggctaggcgcggtggctcacacctgtaatcccaacactttgggaggccaaagcaggcaggtcacctgagatcaggagttcaagaccagcctgaccaacatggtaaaaccctatctctactaaaaatacaaaaattagccaggcatggtggcacatgcctataatcccagctactcgggaggctgaggcaggagaatcactcgaatccaggaggcagaggtcgcactgagctgagatcacaccactgcactccagcctgggcaacagagcaagactccatctcaaaacaaaaacaaaaaaacaaaaaacaaaaaacaaaagcaatttctatgcttgcaactaaacaatgctgagataattctatacttcctccctgagagatgagaaacccctatggctttaaatctcacctgtattgagtacttccaactctagccttagtgtttacctcctgtaggaggacctaacccattcctaacttcagtttggacatttccacttgctgcaaatacttcacgttcaacaggtctacaaaatttccccctacactctacacccaacatacttctgctagtatctcaacatactcaattgctcagcttattcttcttctgttctttcactctcacaattatcaagtctgcaattaccaacctcacttcacaaatgtagcttgaatccagtctttccacttcatctccatcactactgcctaagtttataactcaccatcatcattcctctatccgcaagaacatctcaattttcaatgtttaaatcatctcgttgagaccttttgccactctattgtttatgtcttcattttatttggaaacacttttatcctaacatatgtaacaatttattgcactttgtgttttacatgtctatttcccttatttgaatataaatcctggggaggggaagggagaggagggatgtgggtcagtgtctggtgttgtttccctgactaacaagcatagtacttggccattagagaacacacttaactagctgctgaaagaagaaatgaataaaccatagcagtcttctgccaggctttcctgcctctagcttttcttttctgcaattcacaaccaccacagccgccaaagtcagctttcaaaaaagcacatctgcttaggtctgtctagtacttaacctttatgatctccactgacctcaggataaaattagatcatcttaacatgacatacaaaactcaaaatctggccacaacctttcctttgctttttaaatacattttatttcattcatagaagctttattcacagtagccaaaaacagaagcaacctatatattcatttacgctgaataaacaaattgctctatatccattcaatggaatatctttcagcaataaaaaaaatgtatagttggttcatgtatcttgtccagttttctgtttgtttacagtggaagggcaagtttagcatcagatactctatcatggcagaagcagatatttctagcctatttcttttgcctcatcccatcccaccgtgtggtgcagtctaccccacactacaatttttcctagactttgctgagcaatttattatgtcttaaattcttttcctgcctcagtcatctctttttcatcccacatgacctgactcatatcctacttcatctctggtagtcttccattttctctagggagagagatctttttctccctctatgtttctacagcatattgttcactacggcatttatctcaaggtactgtgtatgtctccccacgaaaatgaatttctaataataatgataatcgctaatatttgggtacttgctatgcgccaggtactgttctaagcactttacccatattaaatcattcaatcttcataaaactctatgacatagctactattatttatttatttttgagataagatctcactctgtcgcccaggctggagtgcagtggaacaatcacggctcactgcagtctcaactcccaggctcaagtgatcctctctcttcagccttccaagtagctgggaccacaggcacacaccaccacacccagctactttttaattttttttttatatagatgggatcccactgtgttgcccaggcaggtcttgaactcctgagcttcagcaatcctttcaccttagcctcccaaagtgctgggattacaggtttgagccactgcacctagccaccaggttctattactatccttgatttacagatgaagaaactaaggcacagagaagttagataaattgcctaagagctcatagcttgacagtggtagaggcaggatgtgaacccaaacagtctgattccagagctcatgattactatactgtctctcctaaattcctggacggcagcaactgggtcttattcttgtttgtacatccatgcccagagcacctcaaatatttgtggaatgaattaaaatttataattttctcctagtcatccatgaaaaagttcttcataagtaatgtaggttttcagtcagtaattacagaactgaatctagaaagggtctttcataaacatggaagagactaaaattaaatttctaataataaattcaaagagctctgaagaattttaccatgcagaaaggactaatgaggttttttaggtagccaaataacagtagtgaactcaggaacataaagtccctacaaaggaatcaacacaccctaagagaagagactaaatgtcataattcgtctccaatagctgcatactaaattaatcctatccatttaaatctgaaatcaagagcatagttttttgaaggcaaaagcaaaaggagtatttaaacaaaaatttaatcctaaaagccaaatctgtcaagagtaatcaatgaaaataaataaagccttactactcaaagaatcatctatgttttagaaacaacaaaagtctaaccaattctgtattggaaaagtattggtcactgcctgtgaaacaactaaaagtacttaaattttagtgatttatacagaaatttaagtaacgaaaatttatatataattttttataaattacatattttatatatatatatattgcacaagtggataattacatttagttagggaaacagtaataaaaccattgggtagaggttgtattgagaggaaggggacagttgatgcatgttgttaccttcagtttattccatcctaccaatctatgtcacatacctgggccatccagcttggacaagtccactatccctcatccaaagtccctgaaaccaaaccaaatgtctttcagaatccaaaatttttctgattttaggaaggtgcattttacccaacactgcagcaggaactgggcaacaccctgtaatcaaaagccttaatatttctgcatcaaatgcataaatattcatattaaatgggataaataaagactataaatagcctcacatcaatccaggtcagatgtgtaagtctaaaaaaattctgttttctgagcttttcagattttaaattgtggaaaaaggattacagacttcaactattacattgtattcaacctggtttattctctgcttgagaactgacgacggcttccttacctgccacattcagatacaatattaatttccatgctagtccggaattggcaacattattggaaataatctagtcaaactccttacttcattgcttaggaaactaaagcccagagagataaaatgacttgcctggggatcacacggttaagtactgacagagatgaaactacaacacacacatctgtctcccaggtcttctttctctttctctctctgtctctgtctgtctgtttctctctctctcgtgcatgctctctctctttctctctggatttgaagtgctttttttaaggcttttcaaaataagaaataattggccaggcgcggtggctcatgcctgtaatcccagcactttgagaggccgaggcgggcagatcacaaggtcaagagatcgagaccatctgggccaacatggtgaaaccccatctctactaaaaatacaaaagttagctgggcgtggtggtgcacacctgtagtcccagctactcgggaggctgaggcaggagaattgcttgaacccaggaggtggaggttgcagtgagtcaagattgcaccactgcactccagcctggcaacgaagcaagactccatctaaaaaaaaaagaaaaaaaagaaataattacagacaaacacaaagttgcagaaacactacagagtcccaggtacccttcacccaatggtgaaatcatgtaatagctatagaacactaaaaccaaaaaattgatattgatagattgttaactacagaccttattccattttcagcatcttttaacctgcatttattttgtgtgtaggtgtatagagttctttgcaactgtattagtctgcactcacattgctataaggaaatacccaagactgggtaattcataaagaaaagaggcttaattgactcacagttctacatggctggggaggcctcaggaaacttacaatcatggccaaaagcacctcttcacaggccagcagaagagagaatgagtgccagtaggggaaatgccagatgtttataaaaccatcagatctcatgagaactcactcactatcatgagaacagccccaatgattaaattatctcccaccagttccctcccatgacacatgggaattatggggattacagttcaagatgagatttaggtgaggacattctgaccctggcccctcccaaatctcgtgtgctcacatttcaaaatgcagtcatgatgcccttccaaaagtcccccaaagtcttaactcattccagcattaacccaaaagtccaagtccaaagtttcatgtgacacaaggcaagtcccttctacctatgagcctataaaatcaaaagcggccgggcgcagtggctcacgcctgtaatcccagcactttgggaggctgagacaggcggatcacgaggtcaggagatcgagaccatcctggctaacacggtgaaaccccatctctattaaaaatacaaaaaaaaattagccaggcatggtggtgggcgcctgtagtcccagctactcaggaggctgaggcaggagaatggcgtgaacccaggaggcagagcttgcagtgagccgagatggcaccactgcactccagcctgggcgacagagtgagaatccgtcaaaaagcaaaacaaaaaaaaatcaaaagcaagtgcattactacctagacacatctctctggggctacaggcactgggtaaatacatctgttccaaatgggagaaactggccaaaacaaaggggatacaggccccacatcaagtccggaatccaacagggcagtcattaaaccttaaaagttccaaaatgatctcctttgattccatgtctcacatccatgtcacgctattacaagaggtgggctcccacagtcttgggaaactctgcccctgtggctttgcagggaacagcccctctcctggctgctttcacagctggcattgagtgtctgaggcttttccagacacatggtgcaagctgtacgtggatctaccattctggggtctgaaggatgtttgctctcttctcacagttccactaggcagtaccccagtgggaactctgtgtgggggctccaaccctacacttcccttccgcactgccctagcagaggttctccatgagggctccacctctgcagcagacttctgcctggacatccaggaatttccatacttcctctgaaatctaggcagagatttccaaacctcaattattgtcttctacacatctcaagctcaataccacatggaagctgccaaggcttggggcttgcaccctctgaagcaacagcctgagctgtaccttggccccttttagccattgctgaagctgctgagatgcagggcaccaagtccagaagctgcatacagcagggggggctggacctggcccaggaaaccatttttctctcataggcctctaggtctatgatgggaggggctgccaagaaggtctctgacacatcctggagacattttccccattgtcttggcaattagcatttggctcctcattacttatgcaaatttgtgcagccagcttgaatttctcctcagaaaatgagtttttcttttctattacaatgtcagggttgcaaattttctaaacttttatgttctgtcacctcttgaatgctctgctgcttaaaaatttcttccactagataccctaaatcatctctctcaagttcaaagttccacagttctctagggcaagggcaaaaagctgccaatctctttgctaaagcatagcaagagtgacctttactccagttcccaacaagtttctcatttccatctaagaccacctcagcctggatttcattgtccatatcactatcagcattttgtcaaagccattcaacaagtctctaggaagttccaaactttcccacatctttcccatgtcttcttctgagccctcccaactgttccaacctctgcctgttacccagctgcaaagtcgcttccacattttcagatatctttatagcagcaccccactctctacggtaccaattagtctgttctcacattgctctaaggagatgccccagactgggtaacttataaagaaaagaggtttaattgacccagagtttcacatcttggcagaaggtgcctcttcacagggcaccaggagagagaatgagtgccagcaggggaaatgtgagatgcttataaaaccatcagctcttgtgagaagttactcactatcatgaaaacagcctggagaaaactacccccatgattcaattaccacccactgagtccctcccacgtggggattatggggattacaattcaagaggagatttgggtggggacacagccaaactgtatcagcaactttatcccatgtatagattcacacactcaccaccacaagactcccaactgttctaccacaatattcctctttgtatttacactcctccctattcctcacattgtccctgactccagaaaacacttactattctccatctccacagttttgtcattttgaaaatgatataaatgttatataaatggaatcagacaatatataaacttttgagatagactttttaaaaaattgggtaaaatttacataaaatttaccatcttaaccattttaagtgtacagctcagtagcattaagtgtattcacagtgttgtataaccaatctccagaactttttatcttgcaaaactgaaatcctataactattaaacaactctccatttcccccttcttccagtccctggagaccacctttctgtttctacacaccatttctctaaatttgactactctagacactttatataagtggaatcacacagtatttgtccttttgtgactggcttatttcacttagcataatgtcctccatatttcactcagcataatgtcctccaggttcatccatattatgacacgtgtgcaacctcaaacacgtgggctcaaacgatcctcccactttggcctctagagcagctgtctagccaacttatttttaggagccaccatgtctagttaatttatttttttatagagatggggtctcactgtgttgcccaagctggtctcaaactcctggcctcaagtgatcctcccacctcagcttcccaaagtgttgggattacaggcatgagccactgtgcctggtccctccttgttttttaaggctgaataatattccatggtaatatataccacattttgttaatcctatcaaccatcaatggacaactgggttgcttctacctcttggctactgtgaatactgctgctatgaacatgggtatacaaatatctctttgagacactgctttcaattcttttggaaacacacccagaagcagaattgttgggtcatatggtaattctatttttaattttttgatgaatgagattgacttttttcactcagaataattcatctgagattcacccaagttgttgtatcagtggttcatttctttttattgttgggtagcatttcgttgttatgtatggaccacagtttgttcaaccactcactaggatatgtgggttgtttccagttgggaaataattaaagacagaattaaaacagtataacaaacagtatatatgtagaggataaattaaagaaaggaaaactatgaatgtagggggaagaatgttgaggaatcaattcacaatgaccaactacaaaattccaacatgagagagaaaaatggtgggaaccatgatactgaagaaataacacacaaaatcatcccaaaataaaggatataggattaagttaagaaggccttcattctccactccaaaaaccatcaaggtgaaattatggaacatcattctaaagaaaggatctttcctctagaaagaacacacagccctatccaagctgtggaatgaaaatggcattaatacaagaaacttaactgcaaaggagaaatacatatatgtaggattttcaacctataattctataggttatggcagcctattacaaataagactgccacaaacatttgtgtataggttttggtatggacataagtttttatttctctggaataaatgctcaggagtctgattgctgggctacatggtaagtgtatgtttaaactgattgatcaatcaactgattgattgagacagggactgactctgtcacccacgctgaagtgcaatggcacgatcatggctcactgcagcctccaacttccgcgctcaagtgatcctcttacctcaacctcccaagtagctgggaccacaggtgtgcaccaccacacccaactaattttttatatattttgtagagacagcattttgccacattgcccaggctggtcttgaaatcctggactcaagtgatctgcctgcctcagcctcccaaagtgctgggattacaggcgtgagccactgtgcccagtcgtatgtttaattttataagaaattgttatgctgttttccagaggggccgaaccattttacattcccatcagcaatgcatgagaaatctagtttatctgcatcgttactagaattacatattatattttttattttagccattctaattggtacatagtagtatcccattgttggtagaagagctgaggcaggactggcttgtctgtcataatgtaaaagagtcttggaagatgtccgggatccagggtctgaaacccctcgtggcctttggaacaccaagctctgtgccaaagggtggaaggctacactgccgcaccacaaatctaagcccagggcataaaaccccttgtggctttgatggaatccagggctcagggcataaacccctcgtagcctctggaatgtgcacagacttgttggttccttgcttctttcttgtaaacatgccctccattatctcaagcagcagagcatattctatatgggtcaaaggaagtgctaaaccgtcacagctacacttaatgcaccactacctttctactctcacctcctcatgccctcacctgtttaccctcatgtcctcaccacctgcttctttgtttgatcaccaataaatagggcgggttcccagagctcggggcctttgcagcctccaatctagcgctggccctctggacacaccttatgaactcttaacttgtcttttctcattcctttgaccccgccagactttgtagccctcagggcctggtgttgggcccgatcacctcaacatcccattgtgattttaatttgcatttcccaaaaggctaataatgttgaacatcttttcatatgcttacttgctacctttataggtttttcttttagcccattttcttttctttcttcttcttttttgttttttaagtgacaaagtcttgctctgttgccaaggctagagtgcagtggtacaatcatagctcactgcagccttgaagtcaaactcttgggttcaaggaagcctcctgcctctgtttccctagtagctgggattacaggcatgcaccaccgcacaagctttttcccctattttctaattgtattgtttgctttcttgagtttagagagttctttttttttttgcaacagagtgtcactctgttgcccaggctggagtgcagtgccgcgatctcactgcaacctctgcctcccagattcaagtgattctcctgcctaagcctctggtgtagcttgaactacaggcacccaccaccacaccggctaatttttgtatttttagtagagacagggtttcaccatgttagccaggctggcctcaaactcctagcctcaagtgatccacctgcctcggcctcccaaagttctgggattacaggcatgagccaccgcacccaacctcttgagttcagagatttctttacataacctggatacaagcccttctttgaatatgtgatttgcaaatattttctcccagtctgtggctaaacttttcaccctctttacagggtctttcacagagctaagtttcaaacttttttttttttcttgagacagagtctcactctgtctcccaggctggcttgctgtggcgcaatctcggctcactgcaacctccgcctcccaagttcaagcgattctcctgcctcagcctcctgagtagctgggattacaggtgcacatcaccacgcccagctaatttttgtatttctagtagagatggggtttcaccatgttggtcaggctggtatcgaactcctgaccttgtgatctgcccgcctcggcctcccaaaatgctgggattacaggcgtgagccaccacgcctggccagttttgaacttttatggagtccaattattgttttcttttatgaattttttggtgtcatgtctaagaactgcttacctagccctaggtcctgaagatgttatcctatgttttcttttttttttgagactgagtcttgctctgtcgcccaagctggagtgcagtggtgcagtctcggctcactgcaacctccacctcctgggtttgagcgattctcatctcaaactcctgacctaaggtgatccacccaccttagcctcccaaagtgctgggaattcaggcatgagccactgcacccggccgtgatattatcctatgttttcttctgaaagttttatagtttaacatttcatgtttaaatccattttaagtggacattgatttcacaaataatccattttacattgatttttaaaaaatactgtgtgaggtttaggtcaaggttcatttttttgcctatgatgttcaattgttccagccctatttttagagaaagaaaaaaaaaaactatcctccctccattgaattgtttttgcacttttgttaaaaatcagttgggcatatttgtgttaatctatttctgggttctctattctgttccattgatctgtctgttcctctgccaataccgcagtgttttgattaatgcagctatatagtaagatttaacagtaggtggaatgattcctcaacccatgctttctttttccaacattttagttatcctaaaatgttctagtttttactattctagctctattcatgctgcttatccttgcttttaaggtcttccccatacctagtagaggtatggtagcctggagaagaaaggggaaaaaagaaagaatcatgaaggaaaaaaacaaatattatataactactaccctaaaacattactcatgtaatttttatccatccatccttcaatggagtcccaatttctccatgaaaggttctctactattccaagccatctctctatgtggtagctcattaaccacaagtcatttgtttccttctgttagatatttgtaaatatcttttgtgtcaactcatcaagggacagggtccatgtttcagacttcttttttttttttttttttgagacaaggtatcactccattgcccaggatggagcacagtggcacgaccacagcttactgcagcctcgacctcctgggcttaaggtatcctctcagctcagcctcccatgtagctaagactgcaggcatgcaccagcaacccggataatttttggtattttttgtagagatggggtttcaccatgttgcccaggttggtctcaaactcctgagctcaagcaatctgcctaccttggcctcccaaagttctgggattgcaggtgtgaaccaccacacctggtctagacttctttatatcacttcataagtttcaataaacatttaattaattatttatctaattatagtttacaacagagagatcctagaaaatctagatgaacaagagtaacaatgagctaaatgctcctctattcctagtaacagaatcattatctcaccaaacctcaagatttttaacctcatttctcatttagtgttaaagaatatatgtcacatctaggctgtttttcccttttcttgacaagatgtcttaggtaaagagatcagtgaatagcaaattatggtggtttcctttttttttttcctgctgtttgctaacaaagtcaccattcacgtaaactttagggctattagacatgattcacccctaacataccatgtagctttattcgaaaagtaaatggctccagcctgggcaacagagcaagactctgcctcaaaaaaataaaaataaaaaaacaaaaaaaatacagctgcttaatccttgattttagttataatttacaataatcattacctgcttaacctctggatcaaatgcctgctcctttgctgaaataactgtgtacagtgtatatacaaatatatacagatacatatccacaccccaaaagtttcttcattggctgtctatgagtttaggctgtttaaataatttgcaacacattattgtagtaaatagaataaaattatatgcagattagctctttcttttcttacaaaatacagcaacacatacatgctaggacaactttgcaaaaacttacttattctgtgcctttccagttctgtcactgtactatagtactacaaggcaggttaggcaacaattaggaaagtttcagaaccattagtctcacaaactttcatctaggatgcctctggtggcctctgaagagatcttctccaaaccctcatctgatgctattgcaactaagtagacgaactacggttctcagaatatacacattaataaggctctttttagcttcacccttttcacttctgtgctttatgatggactacaatactcataatgcaatactacagcccctatcattgacactatcatttccatcaaacacaaagaaacctccttctggattaccaaaaactaagaaatctgggccaggcgcagtggctcatgcctgtaattccaatacgttgggaggcggaggtgggcagatcatgagggcaggagctagagaccatcgtggccaacatggtgaaaccccttctctactaaaaatacaaaaattagctgggcgtggtggcacatgcctgcaatcccagttactggggaggctgaggcaggagaattgcttgaaccagggtgtcagaggttgcagtgagccgagatcaggccactgggcactccagcctggcgatagagcgagactctgtctcaaaaaaaaaaaaaaaaaaaaaaaaaaaaacttaagaaatctcttagttctagtgttatgagaactaggagtaacctgaactcagaagttgtttatgagagtataaactggtacattcactttagaaagcattctaaagataaacatgtgcacatccaacaattacgctcttgtttttatatcctcgtgacatgaacaccaaaagatatgcaaacatatttataacagcatttttcataatattaacaaatgcaacaacccaaatgttaattacaagatgactgtgaggcccggcgtggtggctcacgcctataatcccggcactttgggaggctgaggtgggcagatcacgaggtcaggagttcaagactagcctggccaatatggtgaaaccctgtccctactaaaaatacaaaaattagccaggcatggtggcgggcgcctataatcccaggtacttggggggctgaggcaggagaattacttgaacccgggaggtggaagctgcagtgagccgagactgtgccactgcactccagcctgggcaacaagagtgaaactctgtctgaaaataaataaacaaacaaaagatgactatggtatattcacacaacagaatttcacacacagtaaaaacctaatgaactacagttaaacacacaacatggatgaatctcagaaaccatgaattttaaaaaggaagtcacataaggtcatatgcaataaactatcatatttgtacattgcaaagaaaccagtaaaatgaaacattattatttagaaaaataacaatgtaattttacttatttcattttattttgagacagggtctcttgcccagacaggtgtgcagtggcacaatcacggctcacaacagccttgacctcccagctcaagcaatcgcaatcctcccaagcagctgggactacagatgtgcatccccacgcccaactaatttattttattttttgtagagatagggttttgctatgttgcccaggctggtctcgaactcctgggctcaagcaatctttctactttgcctcccaaagtgctgggatcacagacatgagacaccacaccaggacccctggtaattttgaaaaggaaaagtgtttaaaaacagtttagtgggagtcagggagatggactgaggagtacacatttagcttcaacaggactggtaaagttacaattcttaagttgggtaatagtaggcttattcgtttcattaagctttaaacatatgtgtatgtgttttgagtgtgtatcatctagaatctctggaaaactaacattccagctaatcataaggtgacattcctgataactgggaacgatgccaaggaataaaatcactttattattactatttgataacttttgtagtaagaaaatgacaggtgcctcgaaaaattaaagcaaggggtgggtaagggaagtgagtgtggctaaaaaagcaacatgaggaatccttatagtgctgaatatgttctttatcttaactgtatcaacataaataccctgcttatgatattacaccatcgtttcaaaagatgttaccattgggagaaacagggttaggtgtatattagatttgtgttatttcttccaactgcatgtaaatctaaaactacttcaaaatagaagtttacttttaaaaacaacaatagaaaaaggtccttttagtcctggatttctccaccttggcactactgacattttgcagcacctaattatttcttgtgggtctgtcctgggaattgaagggtagcatccctggcctctatccactaaatgccagtaatgtgcctccattcgtgacaaccaaaaatgtctccatacatgccaaatgtcctcagggggggaaaattgccccagttgagaaccagtgctctagtcataaaagccaagaagagatatgaaaatgttcctaattgaagaagatgaaagagatataacaactaaacgcaatacttgatcctggactgaatcctgtcctggagggtaaagaatgctataaagaacattattaggccaattaacaaaattgaaattaaatggtagattaaataaaagtattgtatcaatattaaatatacctaagttggtaactgtagcgtacttacgtaggagattactgctatgcttaggaaatacatactgaagtatttaggggaaaaggatcgtgatgtatgcaatctaccatcaaatgattcagaaaaaaatatatagaaagatatatacacgtgaatagtatatatatctgtgtgtatatgtatttaatgtatatattgacatatatagacatatctacgtagcaggtggatctgattaaagagtatgcaagtgtgttctttgaactatattatttttgtaacttcgctgtatgtttaaactaattacaattcaggtgtggggtttaagtggaagaaaaaaaaaaaacttttggccgggcacggtggctcacgcctgtaatcccagcactttgggaggccgaggcgggtggatcacgaggtcaggagattgagacgatcctggctaacacggtgaaaccccgtatctactaaaaatacaaaaacaaaattagccggacgtggtggcgggcacctgtagtcccagctactcccgcctgggcgacaaagcgagactccgtctcaaaaaaaaaaaaaaaaaaaacttttataaatcctaaaggcaggtttcacagcagtagtacagcataagtgataaacatcccaagaagataatgactactaacgggataaattcctacttcaaccccaagacattcgttggaaagaattatctaccttcagcctctctctctctccttgcctactttctggaggtgaccccctgaacagtgcgggacagaaaattaatctatcccattaaaaaaaaaaaaaatttctaggaagtgactcaataaacctacatctccgctcgatttctccacaaatcactgaggcatcttcatcctcaacaattaagaagcaaaatcgaggaaagcatacaagtgtttcaaagaaaaccacttatgcactcagctgagcaagaacgttaagtggactagagaagagacaacacggaatgtctaggaggagtgagtaaaaaggaaggactaaaaagagataaatcaggagccagtctgagagagctagaatgcgtatgcccgccagaaaaaaaagtattccaatgagtgcgagtgtgtcagcgggagaggggtagctcacctggctgtggtaagcagagggtgctgagtgcccaccagcttccgcacctgcatagcgatgttgctgagctcgtcgctcagcaggcagcgaaggctcatgaaggacgtggggtaccccacgatcttctccgcctctgacactacctgattccagtgggccggggacttggaggaccgaccacgccaagagcccaccgaggagatggtgtcgagggacggggaccaccacaggcgacgcggggaacccgaggctccaagataacgtggcaagtgcaacagcagctgccgaaagttcatggtttgagtctggaagggtctgggacctgggggtatccagaagtgccgcgggaaacaaaccaggggcagaggaggaacttacagtaactaaaaggaagcggcaattcttgaccctcagagtaaggtggcttcctggagcagtgaccagaaacgaactttaactgctgctttctgcagcccaggctgggcaaacaacagtcccagctcagcactgcccccggccacccggggtagaaaccacagccactgcctatgtggaggacgccatattggaggcatggaatgcggcc

SEQ ID NO: 243 - DNA, 14349 bp, Homo sapiens
agctgggcgcgagcgggtcggcgttgagggagccaccgccctcccgcctgcgcactgcctctcgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggaggtacccgggcgggcggcgggccgcggggcgtggggaggggcgcgggggagaagcgggcgcggggcatagcggtcctcggcgggtgggcggggccggggttgggggcggggcccgcggacttgcgcccctcccccgcccacctgcaactcccccgcccacctgcacccctacccacccaccttcaacccctgtcaattacacccactaggtgtgcttccccaccccctacaccctccgcccagtagtcactggggtgatttactcccatcgccatgtcccacttttaccgaagacaggagggagggtgggccgtgggagggggaccctggagccccgagagctgatggtgtgtctgaccaggcaccgtagctcgagcctgtaatcccaacacattgggagggaggatcgcttgagggcaggagttggaggccagcctgggcaacatagcgaggccccgtccctactacgactggaaaaacaaaggcattttgggttggatgaataaaaaaaagaaaagaaaaagatgtcttctagagaatccaacaggatgctgtagtggttgcccacacctagtctccagctacctaaggaacaaggcaaggagctgtctgcacataaggggcaggccagttcatagatgtaggcacggtcacctggcatcccatggctttcactcacaggctgctgtgctctggtgcacaggggcttccacgggtcttacttaatgtgtgtgatactatcatgtcaacacctgaaatgacactcaagagacgggagaagataccaggcatggtggctcacatctgtaatctcagcagtttgggatgctgaggtgggaggattgcttgatcccagcagttagagactagtcagggcaacagtgagaccctgcctctacaaaaatgaaaattagccaggcttggtggtgtgtgcctgtagtcccaggtgctcaggaaggtgagttgggaggattgcttgagccctggaggttgaggctgcagtgagctgtaattgtgccactgtactccagcctgggtgtgatagagtaagaccgtacctacaaacaaacaaaaacaaaaaaagcaagagaagggaaacgatgccaggtgtggtggcttacacttgtaatcccagcactttgggaggtcaaggcaggaggatggtttgaggccaggagtctgggaccagcttgggcaacacagactccatctctacaaataaaaaataaagaggagggaaggtgaagcattactggacaccgaagatggcttctaggaggcagggactaaggtagtgccagatccaggagcatgtggtatgcggagtcccaggacaatggaggccctcaacaattgaggccctcaacaggctgggctaggtgatgctcttgggaagcagatagtgttgtgctgggattgcaagccccatacacacaatgccatgggaaaatgagcaaaaatctagaagtaatctctgcaattggaaaaaagtcattagtcacagtggtgctatttttttgtgcactgtcattgggaaaatgatatggtttgagggaaagagcacaagaccacagattgcagaccagggccccaccaccagttccccccactgatgacattgccccatgtgagctccaaaactgtttccgatggcttttgtcctctctgcttcaatcctctcatctctaatatggagcaagcacttggattggtatgaagtatctttagaaaaggtttaaagagctccagaaatgttaagtattattattccaaaatgatatctgagcccttgatatacacataaaatggttttagaggacctacagaataagcgcaaggcattttcatgtcctgtgggtgcagaagagtaacagtgcatacacacacggaagtgtaactacctgtctatttctttcattcattcggtgaattttgggtctttatttgagccaggcgctgcacaaggccctgggtcagctttatttaatgtatttgtaccctattttatttcacaaaggatttgaaagctgggaaaggtactgtgtagataagcagactttcactggagcaggagagatgtaatattgaaaaggatgcatggctataatcccagcactttgggaggccaaggcaggaagatcacttgaggttaggactttgagaccagcttggccaacatggtgaaaccccatctctactaaaaatacaaaaattagttgggtgtggccatgcccacctgtagtcccagctactttggaggctggggcagcagaatctcttgaacccgggaggcagaggttgcagtgaaccgagatcgtgccattgcactccagcctgggtgttgcaatgagattccgtctcaaaaaaaaaaaaaaaagatgcatagggatacaatttgaattgatctggaggaagtttgtgggaagattaaagagaacttaaactgacctcattttttcaaatgcagtttggtagaaaccacaagcagtgcaaaacaggaaaaaaaaaaaagccttgcattttaagggaaacctcgagcttcttagggcacatttataccatcattttcatgttcctcactcagcccttacctccagaaccttagctggaccggaaaccaggctcactctacagattaggagaggagtagatgcctggaagtattcaacacacaactactgagctctgctgtgggcagcccatgattggtgaccaagatgctttccctgtctttgggaagcttggggtctagtggagtgaattgacagagggaaataattggcgatgtatcgtgctaggtgctattatagaggagaatatgacacacggtgaaggcacagtcgaagaatgtgtcattaactctgtcctaggggcaggtgagggacagtagacagaaatgctcacagatgaggggaacttgaatagaaatttctagaatgagtagatgccactaaactgtatggtgtgttggtgtgaattagaaaaagggcacatagcaggccgggcgtggtggctcacgccggtaatcccagcacttggggaggccaaggcgggcggatcatgaggtcaggagatcgagacaatcctggctaacacggtgaaaccctatctctactaaaaatacaaaaaattagccagtcgtggtggcaggcacctgtagtcccagctactcgggaggctgaggcaggagaatggtgtgaacccgagaggcggaggttgcagtgagccgagatcgcgccactgaactccagcctgggtgacacaggctgggactccgtctcaaaaaaaaaaaaaaaaagaaaaagggcacatagcagatgactctcatccaggtgcttttatgcagtgaacaacctataacactgtatgggtccatttaacttgccatatagacagaagaaggagactggtaagagcattttgggcaaagaagacaatgtgagcaagagcactaagatagtaaattcaggaagtgaaaggacactgaaggcttgagctctagagcagcgataatggagttgaggtggagagacctgatttaaaagctatcagggggccaggcacagtggctcatgcctgtaatcccagcactttgggaggccgaggcaggtggatcatgaggtcaggagatcgagaccatcctggctaacgcagtgaaaccccatctctactaaaaaaatatatatatatatacaaaaaattagccgggtgtggtggagggcgcctgtagtcccagctactccgggaggctgaggcaggagaatggcgtgaacccgggaggcggagcttgcagtgagccaacatcacgccactgcactccagcctgggagatgagtgaaactccatctcaaaaaaaaaagagctatgagggttagaatgggtaggacttggcagatgatgagggtggggcagagggaggagagagaagaaagtgttcagatggacccgtgggcttgagtgactgaatgaatggtgtggcaccaatcagaccccagggattgaagatggagcagccccagctctcattccccgttgcctgcctgagagccctggtgatttctttccagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttgggtatgtctctccctctacaatcaactttgtagtcctagcaggtgattagcgtaggcttgagtatgggaccttgatatcttccatagtacctagaagaggagatagcatattgatgaaatttaataaatgggtttattgaaagagatcaatttttttttttttttttgccaaaggagacaaagacagccagagaaattcgaaataacacactggctggatgaaattgcttcaatcatagacaattaaacaatttttattttcagctctgcgcggtgctcatgcctgtaatcccagcactttgggaggctgaggcaggtagatcacttgaggccaggagttccagaccagctcattacagcatggtgaaaccccatctctactaaaaatacaaaaattagctgggtgtggtggctcatacctgcaatcccagctactcaggaagctgaggtcgaagaatcgcttgaacccaggaggcagaggttgcagtgacccgagatcacgcctctgcgctccagcctgggcgacacgagattccatctcaaaaaacaaaacaaaatttcatttttatttatttattatttatttatttatctcattatacacccacacacacagatgtacacatacatgcacacatatatatatatgtatatatgggtgtgtgtatacatatatatatatatatatatatatgtatatatatgagctctgatgcactgaggcttccactggtcttgatgtgtgtgattctatctatctatctatctatctatctatctatctataaaaataaagataggatcttgctgtgttgcccagactggtctcaagctcctggccttaggcagtcctcccaccttggcctcctaaaatgctggtattacagtatttatttaagttttaggtgttgtttttttttcgggggctgtttttttggagatagggtcttgctatgttgcccagggtggaatgtagtggttgttcaccagtgccatcatagctcactgcatccttaaactcctggctcaagcagtcttctcccttcagcctcctgaatagctgagactacaggtgtgcgccactgcacctggctgtcctatgcaatatgagaccaggaagttgtcatctgtgtggagaggaataagtgtaatcccacatagggggatagtctaaaacaacatggagagtacctttagacctggattttggggctcagcgttgccatgggaaggaggcatggtgtgtagcagtggttaccagacttctttcagtagtttaaaggaataaaaagagatggaagactgatacagtgttgttctttaattttgccaaggaaagtctttaaaaaaaaaaaaaccctctgttgttcttgtcacttaacactaaaatgtggaaaaacacaatgtcaacaacagcaaaatagcagccaggcgtggtggtacttgcctgtagtcacagctacttgtgaggccgaggtgggaggattggttgagctcaggagttggagtctgcagtgagccatgatcctaccactgtgctccagccagggcaacagagtgagactgtcttttttttttttttttttttgagtcagcgtcttgctctgttgcccaagctgagtgcagtgatgcaagcacagctcactacagccttgacctcccaggtgcaagcaattttgctgcctcagtttcccaagtagctgggactagaggtgcacaccaccacgcctggctaatttttgatgttttttagagatgaggtttcactatgttggccaggatgttctcgaacacctggactcaagtgatcctcctgcctcagactgccaaagtgctgggattacaggcccagcctgtagtttgtgtccggcccggccgagactctgtgtcttaaaaaagaaaacaaaacctttcccaagaaaggacttctgacagtcttacatgtaaacaatttaaagactttatgtctcaggggttccatgtttgtgaaatgagaaataattatagctgctgcacaggcttgtcaaagaggattatataaagagccttggtgtgacccctagccatgtccttttcagagtacgtggctggaactcttagctccttcagtctgacattggagatgactagagaccttgaaccaagtgcccaggaggcagaaactctccaaccactacatctctgtgctggcctccaagaaggattgcccacattgtgggaaagatcatttttattctcagaaaggagcccctggtcaaataacttgcttggaagcatctgggtttccccagtgggctatcagctgcctccaatgctgagaaaacaaagtgtcacatcgctctgcagaactataaaaagatgtttgtttgcgggctgtttggggaaggaaagtgccggccccagctagcagctcccacagcacccttagctgggccttgccccagggttttgtttttcagagctcaccaaggtttgctgaagatctagaagggattttggggaggggttctgggtttgacttgaggtggatgtgcccatgctcaggtggccacagctagagagtgacagcgccaggcaagggcatggcagaaagcaggagatggcgacattcttactttggctgatgagctcctgtgacctatgattcatcagcagcagatgaagttgttgaatgactcagataaaataggcggttcagggcatttcgtagggtgcatttcttactatacagcttatgtatccctagcgtccaccgtgaaggctgcttgggcctcagtctggggtcgttccccattgtcatcagcttgctgcactctggtctaaatgtttctgctgaagctggaccatggtagatgtgggtgtagaatcagccatggctggatctgagcctctggcagcggtggctacttgagcaagcatgttcctgaacctgtctgggccccacttgagcctcatttatgacatagagataagatagcacacacccccaatgtcattgagaggattacatgggataacccatgaatagtggctggcatggagtaatacttagcgagtgttagctggtgttgtattaggtcatagactaagctgttattgaggtagcagcattatcttggggtttactcactgtcttccgcacgtacgggtgatgtatctgattactctgagcactaaataatctaaaaagctggtggcttgcacctatggtcccagttattcgggaggctgaggcaagaggactgcttgagcccaggagttagaggctgcagtgagctatgattgcaccactgccctccagcctgggtgacagaacaagatcctatctcttaaaaaagaagaaaaaaaatctgaaaagtgaattagaaggactgaatttttattttaagaaaatgcaatatgtgattttattcagccctgaaaccagtttgttcagacattagagttaggcattttacctgctctgcatagctacagaataatactagtggcaaggatggggaacacctagaactcttctgcattgctgttgggaatgtaaaatgctgcaaccactttgttaaccacgtgcttaccctatgactgaatgactctactgctaatacttaaaagaaatttgtgcttgtgtccactaaaggtttcttttgtttgtttgtttttgtgatggagtctcacactgtcacccagactggagtgcagtggcgtgatcttagctcactgcaacctccacttcccaggttgaagcagttcccctgcctcagcctccagagtagctgggattacagacacccaccaccatacctggctaatttttgtatttttagtagagatggagtttcaccgttttggccaggctggtcttaaactcctgagctcagatgatccacccacctcggcctcccaaagtgctgggatcacacgtgtgagccaccgtgcctggcctaaaggtcttatataggaatgttcatcccagctttactcataatagccaaaaactggaaacaacccaaatgtccatcaacaagacaacagggtaaataaattacaccatattcatgcaagggtatacttacataatgaataataactaataaaaacaaaaaaacaaactactggtttgtttttattatttatttggtggatacatttcaaaaacattatgttaaaggaaagaagccaggtatgaaagagaacatactatataattctgtttatatatatatttcaagaaaaggcaaaactcatctttactgatggaaggagaagttagagtggttgcttccgtagggattaactgggaagtggcatgaggaaccttaaggaatggaaatgtttcatcttgatctaggtgatggttggatgggtatattcatacttaaaaaaacaactgaactgtacagttaatatttgtacatttattgaatatttcacctcaattctaaaactatatatatataaagggctaggtgtcatatctttccattatacttacatatacctaataatacctaatattatacctaataatagtaattatagttgcttactgataacaacaactaataacacttattgaggccctactctgtgccagggattttctaatcacttaattccctaacacattatgaggttttattgttttctccaattttacagacagggaaactgagacatggagtagttaagttcatttacccagtgtaacacagctggcagtctggttttagattttgtccaatgcacactgtgtggcactgcccaggagcataagctccttgtcaccgaccctctttccttcctgcttagagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaaggtgagggtcagctgcccaggatggtgggtatgtgggaggaggtctgcaaggcatctgtgagtgtttaggtctccatcagaacaccgggggcagcattcatccagattactcaagatgcgatggagtgtcatcccttcccagtcacgctggggagattcaggttaaggtgggcctacctggcctatgacagttagcaaattgtatttcagaaggacagccctcgtcccattggcttccctttgctgtggagaaccgtgacccttgtttaagtttgtgcccttcattggccccctgagtcccttccccgggaaatctgtctttcccctcctgcatcctgccatcttcaggactgtttctctgtgcatctctgctgccctgtcctgcctcttcaccctagtgataggtgttgtgttcatccttatagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagagccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaaaagaggtggatactgagatctaagaggaaaggatagtcattcacgttctgagatatgcgctctctctattgttctcgtacacaaagggatagtctcttttctggagctgatgtccctgcttggaggttagccccaaaacatggctcttgtattgttctaagagaaaaggctttcattttggttcttctgattggtgttacctactgcctaatatgtgttcattttttgacagagaggcagactattgaaaaagtctgtgtgaacagagagcagttcattaagcccattgctttcagtaatgtggccttgaccccttctgcttcccccttctcccatggagcatggcagggcttggttatttagagtccatacatgcaagccattgagagacttgtttgctcaaatgcaagtttgctcaaaaacaggtcctgaaggcttgcttaggattacagggatgctgggtaagaacaccgttcctctctctcgctggagaaatccctgtttctctgactccctttgtgatcctcacagtaatgtattctgtgccactgtaggacacaaggctctgggccagtagaacaggcagagaggtgacactgggcagcaagctgagagctctttctaaatggagtgaaggaattcagtggcctagtttcgccattctctaatgagaaaccaaggccaggctgaaaagtgcaattagatgtggtggattgtggtaacggcctccagataaaggggttatccctgtggaagtgacttttccccatttgatcccttttcaactctaaatggccaggcccagaacagaagaagggttgggtctggaaggaaggctccaaaggatgaaagcttctccctgatcataaggaagtgcatctttatagaattgttgtgcataatgtcagtaaatccctctcacttgacaagggactggattcatcttgccttgagacgggccagtagttatcagtgagtcaaagcaaagtgaaagtttcaggagatgggaccaatggtgcaatgctcgccataacaaaattccttaaaaataaaaaagctaatgttatagcaacaaaaaaagactgaagcaaaaccacactgaaatgcatcccactccaggagaggaattcttagcgtaacactctaaataaatggaaggaatcatcaccttccttattttacctctgccttgttcaccaggctgcccagtgcttaccatgcagaaagcagtcagctgtactctggaagtttctgttcttctttcctggggcttaggatattctgggagctgtctgagccttgtgcctaaggcttatcaggtgatataatcttcctgttctgggctgcttgctggaggaataggaagtgacatttataagacacaggcggtgtgagcatccatgtgtggtcttggtctaaaccagctcttgaacaggttaaagcaaacagcaataacaaaacaaaaactactgatgctgagcgttttgatcctagtaatatttcaaatattgtccttctgcatatgttctatccatatttgattccaatatacattattaagctttcttgggtactattttgctggggctcttgcgtgaaggtggtacctgtctcatgatccttaaaagagagaggcttttttcatccaaagctgtagtgttgggaactggggtgggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 244 - DNA, 14349 bp, Homo sapiens; identical to SEQ ID NO: 243
